United States Patent
Freier et al.

(10) Patent No.: US 12,409,188 B2
(45) Date of Patent: Sep. 9, 2025

(54) MODULATORS OF HSD17B13 EXPRESSION

(71) Applicant: Ionis Pharmaceuticals, Inc., Carlsbad, CA (US)

(72) Inventors: Susan M. Freier, San Diego, CA (US); Susan F. Murray, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/334,632

(22) Filed: Jun. 14, 2023

(65) Prior Publication Data

US 2023/0310483 A1    Oct. 5, 2023

Related U.S. Application Data

(63) Continuation of application No. 17/416,108, filed as application No. PCT/US2019/068051 on Dec. 20, 2019.

(60) Provisional application No. 62/827,524, filed on Apr. 1, 2019, provisional application No. 62/825,581, filed on Mar. 28, 2019, provisional application No. 62/783,680, filed on Dec. 21, 2018.

(51) Int. Cl.
*A61K 31/7088* (2006.01)
*A61P 1/16* (2006.01)
*C12N 15/113* (2010.01)

(52) U.S. Cl.
CPC .......... *A61K 31/7088* (2013.01); *A61P 1/16* (2018.01); *C12N 15/1137* (2013.01)

(58) Field of Classification Search
CPC .... A61K 31/7088; A61P 1/16; C12N 15/1137
See application file for complete search history.

(56) References Cited

U.S. PATENT DOCUMENTS

| | | |
|---|---|---|
| 3,687,808 A | 8/1972 | Merigan, Jr. et al. |
| 4,751,219 A | 6/1988 | Kempen |
| 4,845,205 A | 7/1989 | Huynh Dinh et al. |
| 5,034,506 A | 7/1991 | Summerton et al. |
| 5,130,302 A | 7/1992 | Spielvogel et al. |
| 5,134,066 A | 7/1992 | Rogers et al. |
| 5,166,315 A | 11/1992 | Summerton et al. |
| 5,175,273 A | 12/1992 | Bischofberger et al. |
| 5,185,444 A | 2/1993 | Summerton et al. |
| 5,367,066 A | 11/1994 | Urdea et al. |
| 5,432,272 A | 7/1995 | Benner |
| 5,434,257 A | 7/1995 | Matteucci et al. |
| 5,457,187 A | 10/1995 | Gmeiner et al. |
| 5,457,191 A | 10/1995 | Cook et al. |
| 5,459,255 A | 10/1995 | Cook et al. |
| 5,484,908 A | 1/1996 | Froehler et al. |
| 5,502,177 A | 3/1996 | Matteucci et al. |
| 5,525,711 A | 6/1996 | Hawkins et al. |
| 5,552,540 A | 9/1996 | Haralambidis |
| 5,587,469 A | 12/1996 | Cook et al. |
| 5,587,470 A | 12/1996 | Cook et al. |
| 5,594,121 A | 1/1997 | Froehler et al. |
| 5,596,091 A | 1/1997 | Switzer |
| 5,614,617 A | 3/1997 | Cook et al. |
| 5,645,985 A | 7/1997 | Froehler et al. |
| 5,681,941 A | 10/1997 | Cook et al. |
| 5,698,685 A | 12/1997 | Summerton et al. |
| 5,750,692 A | 5/1998 | Cook et al. |
| 5,763,588 A | 6/1998 | Matteucci et al. |
| 5,808,027 A | 9/1998 | Cook et al. |
| 5,811,534 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'o et al. |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,383,812 B1 | 5/2002 | Chen et al. |
| 6,525,031 B2 | 2/2003 | Manoharan |
| 6,525,191 B1 | 2/2003 | Ramasamy |
| 6,531,584 B1 | 3/2003 | Cook et al. |
| 6,620,916 B1 | 9/2003 | Takahara et al. |
| 6,660,720 B2 | 12/2003 | Manoharan |
| 6,670,461 B1 | 12/2003 | Wengel et al. |
| 6,673,661 B1 | 1/2004 | Liu et al. |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 6,908,903 B1 | 6/2005 | Theodore et al. |
| 7,034,133 B2 | 4/2006 | Wengel et al. |

(Continued)

FOREIGN PATENT DOCUMENTS

| | | |
|---|---|---|
| CN | 103520724 A | 1/2014 |
| CN | 103520724 B | 5/2016 |

(Continued)

OTHER PUBLICATIONS

Manoharan M., et al., "Lipidic Nucleic Acids," Tetrahedron Letters, 1995, vol. 36, No. 21, pp. 3651-3654.
Manoharan M., et al., "Oligonucleotide Conjugates: Alteration of the Pharmacokinetic Properties of Antisense Agents," Nucleosides & Nucleotides, 1995, vol. 14, No. 3-5, pp. 969-973.
Manoharan M., "Oligonucleotide Conjugates as Potential Antisense Drugs with Improved Uptake, Biodistribution, Targeted Delivery, and Mechanism of Action", Antisense & Nucleic Acid Drug Development, 2002, vol. 12, pp. 103-128.
Merwin J R., et al., "Targeted Delivery of DNA Using YEE(GaINAcAH)3, a Synthetic Glycopeptide Ligand for the Asialoglycoprotein Receptor", Bioconjug Chem, 1994, vol. 5, No. 6, pp. 612-620.

(Continued)

*Primary Examiner* — J. E. Angell
(74) *Attorney, Agent, or Firm* — Sheppard Mullin Richter & Hampton LLP

(57) ABSTRACT

Methods, compounds, and compositions useful for inhibiting HSD17B13 expression are provided. Such compounds, compositions, and methods are useful for treating, preventing, or ameliorating a disease associated with HSD 17B 13.

16 Claims, No Drawings

Specification includes a Sequence Listing.

(56) References Cited

U.S. PATENT DOCUMENTS

| | | |
|---|---|---|
| 7,053,207 B2 | 5/2006 | Wengel |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,582,744 B2 | 9/2009 | Manoharan et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Seth et al. |
| 7,750,131 B2 | 7/2010 | Seth et al. |
| 7,851,615 B2 | 12/2010 | Manoharan et al. |
| 7,875,733 B2 | 1/2011 | Bhat et al. |
| 7,939,677 B2 | 5/2011 | Bhat et al. |
| 8,022,193 B2 | 9/2011 | Seth et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,137,695 B2 | 3/2012 | Rozema et al. |
| 8,153,365 B2 | 4/2012 | Wengel et al. |
| 8,158,601 B2 | 4/2012 | Chen et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,313,772 B2 | 11/2012 | Rozema et al. |
| 8,344,125 B2 | 1/2013 | Manoharan et al. |
| 8,349,308 B2 | 1/2013 | Yurkovetskiy et al. |
| 8,404,862 B2 | 3/2013 | Manoharan et al. |
| 8,435,491 B2 | 5/2013 | Wang et al. |
| 8,440,803 B2 | 5/2013 | Swayze et al. |
| 8,450,467 B2 | 5/2013 | Manoharan et al. |
| 8,501,805 B2 | 8/2013 | Seth et al. |
| 8,501,930 B2 | 8/2013 | Rozema et al. |
| 8,530,640 B2 | 9/2013 | Seth et al. |
| 8,541,548 B2 | 9/2013 | Rozema |
| 8,546,556 B2 | 10/2013 | Seth et al. |
| 8,552,163 B2 | 10/2013 | Lee et al. |
| RE44,779 E | 2/2014 | Imanishi et al. |
| 9,005,906 B2 | 4/2015 | Swayze et al. |
| 9,012,421 B2 | 4/2015 | Migawa et al. |
| 2003/0077829 A1 | 4/2003 | MacLachlan |
| 2003/0119724 A1 | 6/2003 | Ts'O et al. |
| 2003/0158403 A1 | 8/2003 | Manoharan et al. |
| 2003/0175906 A1 | 9/2003 | Manoharan et al. |
| 2005/0164235 A1 | 7/2005 | Manoharan et al. |
| 2006/0148740 A1 | 7/2006 | Platenburg |
| 2006/0183886 A1 | 8/2006 | Tso et al. |
| 2008/0039618 A1 | 2/2008 | Allerson et al. |
| 2008/0108801 A1 | 5/2008 | Manoharan et al. |
| 2008/0206869 A1 | 8/2008 | Smith et al. |
| 2008/0281041 A1 | 11/2008 | Rozema et al. |
| 2008/0281044 A1 | 11/2008 | Monahan et al. |
| 2009/0203132 A1 | 8/2009 | Swayze et al. |
| 2009/0203135 A1 | 8/2009 | Forst et al. |
| 2009/0286973 A1 | 11/2009 | Manoharan et al. |
| 2010/0240730 A1 | 9/2010 | Beigelman et al. |
| 2011/0097264 A1 | 4/2011 | Wang et al. |
| 2011/0097265 A1 | 4/2011 | Wang et al. |
| 2011/0123520 A1 | 5/2011 | Manoharan et al. |
| 2011/0207799 A1 | 8/2011 | Rozema et al. |
| 2011/0269814 A1 | 11/2011 | Manoharan et al. |
| 2012/0035115 A1 | 2/2012 | Manoharan et al. |
| 2012/0095075 A1 | 4/2012 | Manoharan et al. |
| 2012/0101148 A1 | 4/2012 | Aking et al. |
| 2012/0128760 A1 | 5/2012 | Manoharan et al. |
| 2012/0136042 A1 | 5/2012 | Manoharan et al. |
| 2012/0157509 A1 | 6/2012 | Hadwiger et al. |
| 2012/0165393 A1 | 6/2012 | Rozema et al. |
| 2012/0230938 A1 | 9/2012 | Rozema et al. |
| 2013/0004427 A1 | 1/2013 | El-Sayed et al. |
| 2013/0109817 A1 | 5/2013 | Yurkovetskiy |
| 2013/0121954 A1 | 5/2013 | Wakefield et al. |
| 2013/0130378 A1 | 5/2013 | Manoharan et al. |
| 2013/0178512 A1 | 7/2013 | Manoharan et al. |
| 2013/0203836 A1 | 8/2013 | Rajeev et al. |
| 2013/0236968 A1 | 9/2013 | Manoharan et al. |
| 2015/0191727 A1 | 7/2015 | Migawa et al. |
| 2018/0216104 A1 | 8/2018 | Abul-Husn et al. |
| 2022/0273691 A1 | 9/2022 | Freier et al. |

FOREIGN PATENT DOCUMENTS

| | | |
|---|---|---|
| CN | 107208092 A | 9/2017 |
| WO | 9720563 A1 | 6/1997 |
| WO | 9746098 A1 | 12/1997 |
| WO | 9813381 A1 | 4/1998 |
| WO | 9914226 A2 | 3/1999 |
| WO | 0063364 A2 | 10/2000 |
| WO | 0243771 A2 | 6/2002 |
| WO | 2004024757 A2 | 3/2004 |
| WO | 2004101619 A1 | 11/2004 |
| WO | 2004106356 A1 | 12/2004 |
| WO | 2007134181 A2 | 11/2007 |
| WO | 2008098788 A2 | 8/2008 |
| WO | 2008101157 A1 | 8/2008 |
| WO | 2009073809 A2 | 6/2009 |
| WO | 2009082607 A2 | 7/2009 |
| WO | 2009126933 A2 | 10/2009 |
| WO | 2009134487 A2 | 11/2009 |
| WO | 2010054406 A1 | 5/2010 |
| WO | 2010088537 A2 | 8/2010 |
| WO | 2010129709 A1 | 11/2010 |
| WO | 2010144740 A1 | 12/2010 |
| WO | 2010148013 A2 | 12/2010 |
| WO | 2011038356 A2 | 3/2011 |
| WO | 2011100131 A2 | 8/2011 |
| WO | 2011120053 A1 | 9/2011 |
| WO | 2011163121 A1 | 12/2011 |
| WO | 2012037254 A1 | 3/2012 |
| WO | 2012068187 A1 | 5/2012 |
| WO | 2012083046 A2 | 6/2012 |
| WO | 2012083185 A2 | 6/2012 |
| WO | 2012089352 A1 | 7/2012 |
| WO | 2012089602 A1 | 7/2012 |
| WO | 2012177947 A2 | 12/2012 |
| WO | 2013033230 A1 | 3/2013 |
| WO | 2013075035 A1 | 5/2013 |
| WO | 2013165816 A2 | 11/2013 |
| WO | 2013166121 A1 | 11/2013 |
| WO | 2014179620 A1 | 11/2014 |
| WO | 2015106128 A2 | 7/2015 |
| WO | 2017011276 A1 | 1/2017 |
| WO | 2017015555 A1 | 1/2017 |
| WO | 2017136758 A1 | 8/2017 |
| WO | 2018/136702 A1 | 7/2018 |
| WO | 2018/136758 A1 | 7/2018 |
| WO | 2018190970 A1 | 10/2018 |
| WO | 2019183329 A1 | 9/2019 |
| WO | 2020/061177 A1 | 3/2020 |
| WO | 2020132564 A1 | 6/2020 |
| WO | 2023/039076 A1 | 3/2023 |
| WO | 2023/091644 A2 | 5/2023 |

OTHER PUBLICATIONS

Mishra R.K., et al., "Improved Leishmanicidal Effect of Phosphorotioate Antisense Oligonucleotides by LDL-Mediated Delivery," Biochimica et Biophysica Acta, 1995, vol. 1264, No. 2, pp. 229-237.

Nishina K., et al., "Efficient In Vivo Delivery of siRNA to the Liver by Conjugation of α-Tocopherol", Molecular Therapy, vol. 16, No. 4, Apr. 2008, pp. 734-740.

Nishina T., et al., "Chimeric Antisense Oligonucleotide Conjugated to a-Tocopherol", Molecular Therapy Nucleic Acids, 2015, 4, e220, pp. 1-10.

(56) References Cited

OTHER PUBLICATIONS

Oberhauser B., et al., "Effective Incorporation of 2'-O-Methyl-Oligoribonucleotides into Liposomes and Enhanced Cell Association through Modification with Thiocholesterol," Nucleic Acids Research, 1992, vol. 20, No. 3, pp. 533-538.
Oka N., et al., "An Oxazaphospholidine Approach for the Stereocontrolled Synthesis of Oligonucleoside Phosphorothioates", J Am Chem Soc, Jun. 14, 2003, vol. 125, No. 27, pp. 8307-8317.
Orum H., et al., "Locked Nucleic Acids: A Promising Molecular Family for Gene-Function Analysis and Antisense Drug Development," Current Opinion in Molecular Therapeutics, 2001, vol. 3, No. 3, pp. 239-243.
Pavia A A., et al., "Synthetic TN Glycopeptide Related to Human Glycophorin AM", High-field Proton and Carbon-13 Nuclear Magnetic Resonance Study, Int J Pep Protein Res, 1983, vol. 22, pp. 539-548.
Pujol A M., et al., "A Sulfur Tripod Glycoconjugate that Releases a High-Affinity Copper Chelator in Hepatocytes", Angewandte Chem. Int. Ed., 2012, vol. 51, pp. 7445-7448.
Rajur S B., et al., "Covalent Protein-Oligonucleotide Conjugates for Efficient Delivery of Antisense Molecules", Bioconjugate Chem., 1997, vol. 8, pp. 935-940.
Ravi Kanth V V., et al., "Genetics of Non-Alcoholic Fatty Liver Disease: From Susceptibility and Nutrient Interactions to Management", World Journal of Hepatology, Jul. 18, 2016, vol. 8, Issue 20, pp. 827-837.
Rensen P C N., et al., "Design and Synthesis of Novel N-Acetylgalactosamine-Terminated Glycolipids for Targeting of Lipoproteins to the Hepatic Asialoglycoprotein Receptor", J. Med. Chem., 2004, vol. 47, doi:10.1021/jm049481d, pp. 5798-5808, XP002551237.
Rensen P C N., et al., "Determination of the Upper Size Limit for Uptake and Processing of Ligands by the Asialoglycoprotein Receptor on Hepatocytes in Vitro and in Vivo", J. Biol. Chem., Oct. 5, 2001, vol. 276, No. 40, pp. 37577-37584.
Rensen P C N., et al., "Stimulation of Liver-Directed Cholesterol Flux in Mice by Novel N-Acetylgalactosamine-Terminated Glycolipids with High Affinity for the Asialoglycoprotein Receptor", Arterioscler Thromb Vase Biol, 2006, vol. 26, pp. 169-175.
Saison-Behmoaras T., et al., "Short Modified Antisense Oligonucleotides Directed Against Ha-ras Point Mutation Induce Selective Cleavage of the mRNA and Inhibit T24 Cells Proliferation," The EMBO Journal, 1991, vol. 10, No. 5, pp. 1111-1118.
Sanghvi et al., "Carbohydrate Modifications in Antisense Research", ACS Symposium Series vol. 580, Chapters 3 and 4, 1994, pp. 40-65.
Sanghvi Y.S., "Heterocyclic Base Modifications in Nucleic Acids and Their Applications in Antisense Oligonucleotides," Antisense Research and Applications, Chapter 15, 1993, pp. 273-288.
Banyal A J., "NASH: A Global Health Problem", Hepatology Research, 2011, vol. 41, pp. 670-674.
Sato M., et al., "Glycoinsulins: Dendritic Sialyloligosaccharide-Displaying Insulins Showing a Prolonged Blood-Sugar-Lowering Activity", J. Am. Chem. Soc., 2004, vol. 126, No. 43, pp. 14013-14022.
Seth P.P., et al., "Short Antisense Oligonucleotides with Novel 2'-4' Conformationaly Restricted Nucleoside Analogues Show Improved Potency Without Increased Toxicity in Animals," Journal of Medicinal Chemistry, 2009, vol. 52, No. 1, pp. 10-13.
Shea R G., et al., "Synthesis, Hybridization Properties and Antiviral Activity of Lipid-Oligodeoxynucleotide Conjugates", Nucleic Acids Research, vol. 18, No. 13, 1990, pp. 3777-3783.
Singh S.K., et al., "LNA (Locked Nucleic Acids): Synthesis and High-Affinity Nucleic Acid Recognition," Chemical Communications, 1998, vol. 4, pp. 455-456.
Singh S.K., et al., "Synthesis of 2'-Amino-LNA: A Novel Conformationally Restricted High-Affinity Oligonucleotide Analogue with a Handle," Journal of Organic Chemistry, 1998, vol. 63, No. 26, pp. 10035-10039.

Sliedregt L A J M., et al., "Design and Synthesis of Novel Amphiphilic Dendritic Galactosides for Selective Targeting of Liposomes to the Hepatic Asialoglycoprotein Receptor", J. Med. Chem., 1999, vol. 42, pp. 609-618.
Srivastava P., et al., "Five- and Six-Membered Conformationally Locked 2',4'-Carbocyclic ribo-Thymidines: Synthesis, Structure, and Biochemical Studies", J. Am. Chem. Soc., 2007, vol. 129, No. 26, pp. 8362-8379.
Su W., et al., "Role of HSD17B13 in the liver physiology and pathophysiology", Molecular and Cellular Endocrinology, 2018, pp. 1-7.
Svinarchuk F.P., et al., "Inhibition of HIV Proliferation in MT-4 Cells by Antisense Oligonucleotide Conjugated to Lipophilic Groups," Biochimie, 1993, vol. 75, No. 1-2, pp. 49-54.
Tomiya N., et al., "Liver-Targeting of Primaquine-(Poly-γ-Glutamic Acid) and its Degradation in Rat Hepatocytes", Bioorganic & Medicinal Chemistry, 2013, vol. 21, pp. 5275-5281.
Toyokuni T., et al., "Synthetic Vaccines: I. Synthesis of Multivalent Tn Antigen Cluster-Lysyllysine Conjugates", Tetrahedron Lett, 1990, vol. 31, No. 19, pp. 2673-2676.
Valentijn A R P M., et al., "Solid-Phase Synthesis of Lysine-Based Cluster Galactosides with High Affinity for the Asialoglycoprotein Receptor", Tetrahedron, 1997, vol. 53, No. 2, pp. 759-770.
Van Rossenberg SMW., et al., "Stable Polyplexes Based on Arginine-Containing Oligopeptides for in Vivo Gene Delivery", Gene Therapy, 2004, vol. 11, pp. 457-464.
Wahlestedt C., et al., "Potent and Nontoxic Antisense Oligonucleotides Containing Locked Nucleic Acids," Proceedings of the National Academy of Science, May 9, 2000, vol. 97, No. 10, pp. 5633-5638.
Wan W B., et al., "Synthesis, Biophysical Properties and Biological Activity of Second Generation Antisense Oligonucleotides Containing Chiral Phosphorothioate Linkages", Nucleic Acids Research, Nov. 14, 2014, vol. 42, No. 22, pp. 13456-13468.
Westerlind U., et al., "Ligands of the Asialoglycoprotein Receptor for Targeted Gene Delivery, Part 1: Synthesis of and Binding Studies with Biotinylated Cluster Glycosides Containing N-Acetylgalactosamine", Glycoconjugate Journal, 2004, vol. 21, pp. 227-241.
Woolf T.M., et al., "Specificity of Antisense Oligonucleotides in Vivo," Proceedings of the National Academy of Sciences of the United States of America (PNAS), Aug. 1992, vol. 89, No. 16, pp. 7305-7309.
Zhang J., et al., "PowerBLAST: A New Network BLAST Application for Interactive or Automated Sequence Analysis and Annotation", Genome Research, 1997, vol. 7, pp. 649-656.
Zhang X., et al., "Omic Studies Reveal the Pathogenic Lipid Droplet Proteins in Non-Alcoholic Fatty Liver Disease", Protein Cell, 2017, vol. 8, No. 1, pp. 4-13.
Zhou C., et al., "Fine Tuning of Electrostatics around the Internucleotidic Phosphate through Incorporation of Modified 2',4'-Carbocyclic-LNAs and -ENAs Leads to Significant Modulation of Antisense Properties", J. Org. Chem, 2009, vol. 74, No. 1, pp. 118-134.
European Search Report for EP Patent Application No. EP 19 77 2339, dated Jan. 21, 2022.
International Search Report for International Application No. PCT/US2019/23333, dated Jun. 6, 2019.
International Search Report for International Application No. PCT/US2019/68051, dated May 14, 2020.
Su et al., "Liver X receptor α induces 17β-hydroxysteroid dehydrogenase-13 expression through SREBP-1c", Am. J. Phys. Endocrin. Metab., 312(4):E357-E367 (Apr. 2017).
Su et al., "Comparative proteomic study reveals 17β-HSD13 as a pathogenic protein in nonalcoholic fatty liver disease" PNAS., 111(31):11437-11442 (Jul. 2014).
Wang M. et al., "Inhibition of LXRα/SREBP-1c-Mediated Hepatic Steatosis by Jiang-Zhi Granule", Evid. Based Compl. Alt. Med., 2013:1-10 (2013).
Abul-Husn N.S., et al., "A Protein-Truncating HSD17B13 Variant and Protection from Chronic Liver Disease", New Englnd Journal of Mdeicine, Mar. 22, 2018, vol. 378, No. 12, pp. 1096-1106.

(56) References Cited

OTHER PUBLICATIONS

Adam M., et al., "Hydroxysteroid (17β) Dehydrogenase 13 Deficiency Triggers Hepatic Steatosis and Inflammation in Mice", The FASEB Journal, 2018, vol. 32, No. 6, pp. 3434-3447.
Albaek N., et al., "Analogues of a Locked Nucleic Acid with Three Carbon 2', 4'-Linkages: Synthesis by Ring Closing Metathesis and Influence of Nucleic Acid Duplex Stability and Structure", J. Org. Chem. 2006, vol. 71, No. 20, pp. 7731-7740.
Altschul S.F., et al., "Basic Local Alignment Search Tool," Journal of Molecular Biology, Oct. 1990, vol. 215 (3), Elsevier, Netherlands, pp. 403-410.
Biessen E A L., et al., "Novel Hepatotrophic Prodrugs of the Antiviral Nucleoside 9-(2-Phosphonylmethoxyethyl) Adenine with Improved Pharmacokinetics and Antiviral Activity", FASEB J. , Sep. 2000, vol. 14, pp. 1784-1792.
Biessen E A L., et al., "The Cholesterol Derivative of a Triantennary Galactoside with High Affinity for the Hepatic Asialoglycoprotein Receptor: A Potent Cholesterol Lowering Agent", J. Med. Chem. 1995, vol. 38, No. 11, pp. 1846-1852.
Biessen E A L., et al., "Synthesis of Cluster Galactosides with High Affinity for the Hepatic Asialoglycoprotein Receptor", J. Med. Chem. 1995, vol. 38, No. 9, pp. 1538-1546.
Braasch D A., et al., "Novel Antisense and Peptide Nucleic Acid Strategies for Controlling Gene Expression", Biochemistry, Apr. 9, 2002, vol. 41, No. 14, pp. 4503-4510.
Braasch D.A., et al., "Locked Nucleic Acid (LNA): Fine-Tuning the Recognition of DNA and RNA," Chemistry and Biology, 2001, vol. 8, pp. 1-7.
Connolly D T., et al., "Binding and Endocytosis of Cluster Glycosides by Rabbit Hepatocytes", J Biol Chem, Jan. 25, 1982, vol. 257, No. 2, pp. 939-945.
Crooke S T., "Antisense Drug Technology", Second Edition, CRC Press, 2008, Chapters 1-28, 414 Pages.
Crooke S.T., et al.,"Pharmacokinetic Properties of Several Novel Oligonucleotide Analogs in Mice," The Journal of Pharmacology and Experimental Therapeutics, 1996, vol. 277, No. 2, pp. 923-937.
Duff R J., et al., "Intrabody Tissue-Specific Delivery of Antisense Conjugates in Animals: Ligand-Linker-Antisense Oligomer Conjugates", Methods in Enzymology, 1999, vol. 313, pp. 297-321.
Egli M., et al., "Synthesis, Improved Antisense Activity and Structural Rationale for the Divergent RNA Affinities of 3'-Fluoro Hexitol Nucleic Acid (FHNA and Ara-FHNA) Modified Oligonucleotides," Journal of the American Chemical Society, Oct. 19, 2011, vol. 133, No. 41, pp. 16642-16649.
Elayadi A.N., et al., "Application of PNA and LNA Oligomers to Chemotherapy," Current Opinion in Investigational Drugs, 2001, vol. 2, pp. 558-561.
Englisch U., et al., "Chemically Modified Oligonucleotides as Probes and Inhibitors," Angewandte Chemie, Jun. 1991, vol. 30, No. 6, pp. 613-729.
Freier S.M., et al., "The Ups and Downs of Nucleic Acid Duplex Stability: Structure-Stability Studies on Chemically-Modified DNA: RNA Duplexes," Nucleic Acids Research, 1997, vol. 25, No. 22, pp. 4429-4443.
Frieden M., et al., "Expanding the Design Horizon of Antisense Oligonucleotides with Alpha-L-LNA," Nucleic Acids Research, 2003, vol. 31, No. 21, pp. 6365-6372.
Gautschi O., et al., "Activity of a Novel bcl-2/bcl-xL-Bispecific Antisense Oligonucleotide Against Tumors of Diverse Histologic Origins," Journal of the National Cancer Institute, Mar. 21, 2001, vol. 93, No. 6, pp. 463-471.
Hashimoto E., et al., "Prevalence, Gender, Ethnic Variations, and Prognosis of NASH", J Gastroenterol, 2011, vol. 46, pp. 63-69.
International Preliminary Report on Patentability for International Application No. PCT/US2019/068051, dated Jul. 1, 2021, 8 Pages.
Jayaprakash K N., et al., "Non-Nucleoside Building Blocks for Copper-Assisted and Copper-Free Click Chemistry for the Efficient Synthesis of RNA Conjugates", Organic Letters, 2010, vol. 12, No. 23, pp. 5410-5413.

Kabanov A.V., et al., "A New Class of Antivirals: Antisense Oligonucleotides Combined with a Hydrophobic Substituent Effectively Inhibit Influenza Virus Reproduction and Synthesis of Virus-Specific Proteins in MDCK Cells," FEBS Letters, Jan. 1990, vol. 259, No. 2, pp. 327-330.
Kahali B., et al., "Insights from Genome-Wide Association Analyses of Nonalcoholic Fatty Liver Disease", Semin Liver Dis Nov. 2015, vol. 35, No. 4, 375-391, 29 Pages.
Kato K., et al., "N-Acetylgalactosamine Incorporation into a Peptide Containing Consecutive Threonine Residues by UDP-N-Acetyl-D-Galactosaminide:Polypeptide N-Acetylgalactosaminyltransferases", Glycobiology, 2001, vol. 11, No. 10, pp. 821-829.
Khorev O., et al., "Trivalent, Gal/GalNAc-Containing Ligands Designed for the Asialoglycoprotein Receptor", Bioorganic & Medicinal Chemistry, 2008, vol. 16, pp. 5216-5231.
Kim J M., et al., "Oligomeric Glycopeptidomimetics Bearing the Cancer Related TN-Antigen", Tetrahedron Letters, 1997, vol. 38, No. 20, pp. 3487-3490.
Kornilova A Y., et al., "Development of a Fluorescence Polarization Binding Assay for Asialoglycoprotein Receptor", Analytical Biochemistry, 2012, vol. 425, pp. 43-46.
Koshkin A.A., et al., "LNA (Locked Nucleic Acids): Synthesis of the Adenine, Cytosine, Guanine, 5-Methylcytosine, Thymine and Uracil Bicyclonucleoside Monomers, Oligomerisation and Unprecedented Nucleic Acid Recognition," Tetrahedron, 1998, vol. 54, No. 14, pp. 3607-3630.
Kristiansen M N B., et al., "Molecular Characterization of Microvesicular and Macrovesicular Steatosis Shows Widespread Differences in Metabolic Pathways", Lipids, Feb. 5, 2019, vol. 54, pp. 109-115.
Kroschwitz J.I., "Concise Encyclopedia of Polymer Science and Engineering," John Wiley & Sons, NY, 1990, pp. 858-859.
Kumar R., et al., "The First Analogues of LNA (Locked Nucleic Acids): Phosphorothioate-LNA and 2'-Thio-LNA," Bioorganic and Medicina Chemistry Letters, 1998, vol. 8, No. 16, pp. 2219-2222.
Kumar V., et al., "Design, Synthesis, Biophysical and Primer Extension Studies of Novel Acyclic Butyl Nucleic Acid (BuNA) †", Organic Biomolecular Chemistry, Jul. 9, 2013, vol. 11, pp. 5853-5865.
Lee D J., et al., "Synthesis of Multivalent Neoglyconjugates of MUC1 by the Conjugation of Carbohydrate-Centered, Triazole-Linked Glycoclusters to MUC1 Peptides using Click Chemistry", J Org Chem, 2012, vol. 77, pp. 7564-7571.
Lee M-R., et al., "Protein Microarrays to Study Carbohydrate-Recognition Events", Bioorg Med Chem Lett, 2006, vol. 16, No. 19, pp. 5132-5135.
Lee R T., et al., "Preparation of Cluster Glycosides of N-Acetylgalactosamine that have Subnanomolar Binding Constants Towards the Mammalian Hepatic Gal/GalNAc-specific Receptor", Glycoconjugate J., 1987, vol. 4, pp. 317-328.
Lee R T., et al., "Facile Synthesis of a High-Affinity Ligand for Mammalian Hepatic Lectin Containing Three Terminal N-Acetylgalactosamine Residues", Bioconjugate Chem., 1997, vol. 8, No. 5, pp. 762-765.
Lee R T., et al., "New and More Efficient Multivalent Glyco-Ligands for Asialoglycoprotein Receptor of Mammalian Hepatocytes", Bioorganic & Medicinal Chemistry, 2011, vol. 19, pp. 2494-2500.
Lee R T., et al., "New Synthetic Cluster Ligands for Galactose/N-Acetylgalactosamine-Specific Lectin of Mammalian Liver", Biochem, 1984, vol. 23, pp. 4255-4261.
Lee R T., et al., "Synthesis of Peptide-Based Trivalent Scaffold for Preparation of Cluster Glycosides", Methods in Enzymology, 2003, vol. 362, pp. 38-43.
Lee Y C., "Synthesis of Some Cluster Glycosides Suitable for Attachment to Proteins or Solid Matrices", Carbohydrate Research, 1978, vol. 67, pp. 509-514.
Letsinger R L., et al., "Cholesteryl-Conjugated Oligonucleotides: Synthesis, Properties, and Activity as Inhibitors of Replication of Human Immunodeficiency Virus in Cell Culture", Proc. Natl. Acad. Sci. USA, Sep. 1989, vol. 86, pp. 6553-6556.
Leumann C J., "DNA Analogues: From Supramolecular Principles to Biological Properties", Bioorganic & Medicinal Chemistry, 2002, vol. 10, pp. 841-854.

(56) References Cited

OTHER PUBLICATIONS

Liu S., et al., "Molecular Cloning and Expression Analysis of a New Gene for Short-Chain Dehydrogenase/Reductase 9", Acta Biochimica Polonica, 2007, vol. 54, No. 1, pp. 213-218.

Maher L.J., et al., "Comparative Hybrid Arrest By Tandem Antisense Oligodeoxyribonucleotides or Oligodeoxy-Ribonucleoside Methylpbosphonates in A Cell-Free System," Nucleic Acids Research, 1988, vol. 16, No. 8, pp. 3341-3358.

Maier M A., et al., "Synthesis of Antisense Oligonucleotides Conjugated to a Multivalent Carbohydrate Cluster for Cellular Targeting", Bioconjugate Chemistry, 2003, vol. 14, doi:10.1021/bc020028v, pp. 18-29, XP002510288.

Maierhofer C., et al., "Probing Multivalent Carbohydrate-Lectin Interactions by an Enzyme-Linked Lectin Assay Employing Covalently Immobilized Carbohydrates", Bioorganic & Medicinal Chemistry, 2007, vol. 15, pp. 7661-7676.

Manoharan M., et al., "Chemical Modifications to Improve Uptake and Bioavailability of Antisense Oligonucleotides," Annals of the New York Academy of Sciences, 1992, vol. 660, pp. 306-309.

Manoharan M., et al., "Cholic Acid-Oligonucleotide Conjugates for Antisense Applications," Bioorganic and Medicinal Chemistry Letters, 1994, vol. 4, No. 8, pp. 1053-1060.

Manoharan M., et al., "Introduction of a Lipophilic Thioether Tether in the Minor Groove of Nucleic Acids for Antisense Applications," Bioorganic and Medicinal Chemistry Letters, 1993, vol. 3, No. 12, pp. 2765-2770.

Caldwell S., et al., "Cryptogenic Cirrhosis: What We Are Missing ?", Curr Gastroenterol Rep, Jan. 27, 2010, pp. 40-48.

Chan J.H.P., et al., "Antisense Oligonucleotides: from Design to Therapeutic Application", Clinical and Experimental Pharmacology and Physiology, 2006, vol. 33, No. 5-6, pp. 533-540, DOI: doi.org/10.1111/j.1440-1681.2006.04403.x.

Shemesh C.S., et al., "Assessment of the Drug Interaction Potential of Unconjugated and GalNAc3-Conjugated 2'-MOE-ASOs", Molecular Therapy—Nucleic Acids, vol. 9, 2017, pp. 34-47, DOI: 10.1016/j.omtn.2017.08.012.

Supplementary European Search Report in European Patent Application No. 19900290.8, dated Apr. 28, 2023, 5 Pages.

Ma et al., "Hsd17b13 Deficiency Does Not Protect Mice From Obesogenic Diet Injury" Hepatology (2021) 73: 1701-1716.

Zhaochun "Practical Clinical Hepatology" People's Military Medical Press (2015) p. 379.

MODULATORS OF HSD17B13 EXPRESSION

SEQUENCE LISTING

The present application is being filed along with a Sequence Listing in electronic format. The Sequence Listing is provided as a file entitled BIOL0350WOSEQ_ST25.txt created Dec. 13, 2019, which is 640 kb in size. The information in the electronic format of the sequence listing is incorporated herein by reference in its entirety.

FIELD

The present embodiments provide methods, compounds, and compositions useful for inhibiting hydroxysteroid 17-beta dehydrogenase 13 (LOC345275; 17-beta hydroxysteroid dehydrogenase; HSD17B13; HSD17013) expression, and in certain instances, reducing the amount of HSD17B13 protein in a cell or animal, which can be useful for treating, preventing, or ameliorating a disease associated with HSD17B13.

BACKGROUND

Non-alcoholic fatty liver disease (NAFLD) covers a spectrum of liver disease from steatosis to nonalcoholic steatohepatitis (NASH) and cirrhosis. NAFLD is defined as fat accumulation in the liver exceeding 5% by weight, in the absence of significant alcohol consumption, steatogenic medication, or hereditary disorders (Kotronen et al, Arterioscler Thromb. Vasc. Biol. 2008, 28: 27-38).

Non-alcoholic steatohepatitis (NASH) is NAFLD with signs of inflammation and hepatic injury. NASH is defined histologically by macrovesicular steatosis, hepatocellular ballooning, and lobular inflammatory infiltrates (Sanyal, Hepatol. Res. 2011. 41: 670-4). NASH is estimated to affect 2-3% of the general population. In the presence of other pathologies, such as obesity or diabetes, the estimated prevalence increases to 7% and 62% respectively (Hashimoto et al, J. Gastroenterol. 2011. 46(1): 63-69).

SUMMARY

Certain embodiments provided herein are compounds and methods for reducing the amount or activity of HSD17B13 mRNA, and in certain embodiments, reducing the amount or activity of HSD17B13 protein in a cell or animal. In certain embodiments, the animal has a liver disease. In certain embodiments, the disease is NASH. In certain embodiments, the disease is alcoholic steatohepatitis (ASH). In certain embodiments, the disease is NAFLD. In certain embodiments, the disease is hepatic steatosis. In certain embodiments, the disease is cirrhosis. In certain embodiments, the disease is hepatocellular carcinoma. In certain embodiments, the disease is alcoholic liver disease. In certain embodiments, the disease is HCV hepatitis. In certain embodiments, the disease is chronic hepatitis. In certain embodiments, the disease is hereditary hemochromatosis. In certain embodiments, the disease is primary sclerosing cholangitis. Certain compounds provided herein are directed to compounds and compositions that reduce liver damage, steatosis, liver fibrosis, liver inflammation, liver scarring or cirrhosis, liver failure, liver enlargement, elevated transaminases, or hepatic fat accumulation in an animal.

Certain embodiments provided herein are directed to potent and tolerable compounds and compositions useful for inhibiting HSD17B13 expression, which can be useful for treating, preventing, ameliorating, or slowing progression of liver diseases. Certain embodiments provided herein are directed to compounds and compositions that are more potent or have greater therapeutic value than compounds publicly disclosed.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION number indicate a combination of nucleobase sequence, chemical modification, and motif.

Definitions

Unless otherwise indicated, the following terms have the following meanings:

"2'-deoxyfuranosyl sugar moiety" or "2'-deoxyfuranosyl sugar" means a furanosyl sugar moiety having two hydrogens at the 2'-position. 2'-deoxyfuranosyl sugar moieties may be unmodified or modified and may be substituted at positions other than the 2'-position or unsubstituted. A β-D-2'-deoxyribosyl sugar moiety in the context of an oligonucleotide is an unsubstituted, unmodified 2'-deoxyfuranosyl and is found in naturally occurring deoxyribonucleic acids (DNA).

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE) refers to a 2'-O ($CH_2$)$_2$—$OCH_3$) in the place of the 2'-OH group of a ribosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within 10% of a value. For example, if it is stated, "the compounds affected about 70% inhibition of HSD17B13", it is implied that HSD17B13 levels are inhibited within a range of 60/c and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a ribosyl bicyclic sugar moiety wherein the second ring of the bicyclic sugar is formed via a bridge connecting the 4'-carbon and the 2'-carbon, wherein the bridge has the formula: 4'-CH($CH_3$)—O-2', and wherein the methyl group of the bridge is in the S configuration.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonuclotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides.

Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"HSD17B13" means any nucleic acid or protein of HSD17B13. "HSD17B13 nucleic acid" means any nucleic acid encoding HSD17B13. For example, in certain embodiments, a HSD17B13 nucleic acid includes a DNA sequence encoding HSD17B13, an RNA sequence transcribed from DNA encoding HSD17B13 (including genomic DNA comprising introns and exons), and an mRNA sequence encoding HSD17B13. "HSD17B13 mRNA" means an mRNA encoding a HSD17B13 protein. The target may be referred to in either upper or lower case.

"HSD17B13 specific inhibitor" refers to any agent capable of specifically inhibiting HSD17B13 RNA and/or HSD17B13 protein expression or activity at the molecular level. For example, HSD17B13 specific inhibitors include nucleic acids (including antisense compounds), peptides, antibodies, small molecules, and other agents capable of inhibiting the expression of HSD17B13 RNA and/or HSD17B13 protein.

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating HSD17B13 RNA can mean to increase or decrease the level of HSD17B13 RNA and/or HSD17B13 protein in a cell, tissue, organ or organism. A "modulator" effects the change in the cell, tissue, organ or organism. For example, a HSD17B13 compound can be a modulator that decreases the amount of HSD17B13 RNA and/or HSD17B13 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and, optionally, one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence-databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide.

"Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof.

"Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. As used herein, "unmodified sugar moiety" means a p-D-ribosyl moiety, as found in naturally occurring RNA, or a β-D-2'-deoxyribosyl sugar moiety as found in naturally occurring DNA. As used herein, "modified sugar moiety" or "modified sugar" means a sugar surrogate or a furanosyl sugar moiety other than a β-D-ribosyl or a β-D-2'-deoxyribosyl. Modified furanosyl sugar moieties may be modified or substituted at a certain position(s) of the sugar moiety, substituted, or unsubstituted, and they may or may not have a stereoconfiguration other than β-D-ribosyl. Modified furanosyl sugar moieties include bicyclic sugars and non-bicyclic sugars.

"Sugar surrogate" means a modified sugar moiety that docs not comprise a furanosyl or tetrahydrofuranyl ring (is not a "furanosyl sugar moiety") and that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or nucleic acids.

"Synergy" or "synergize" refers to an effect of a combination that is greater than additive of the effects of each component alone at the same doses.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

Certain Embodiments

Certain embodiments provide methods, compounds and compositions for inhibiting HSD17B13 expression.

Certain embodiments provide compounds targeted to a HSD17B13 nucleic acid. In certain embodiments, the HSD17B13 nucleic acid has the sequence set forth in RefSeq or GENBANK Accession No. NM_178135.4 (incorporated by reference, disclosed herein as SEQ ID NO: 1), the complement of GENBANK Accession No. NC_000004.12 truncated from nucleotides 87301001 to 87326000 (incorporated by reference, disclosed herein as SEQ ID NO: 2), the sequence listed as SEQ ID NO: 3, or GENBANK Accession No. NM_001136230.2 (incorporated by reference, disclosed herein as SEQ ID NO: 4). In certain embodiments, the compound is an antisense compound or oligomeric compound. In certain embodiments, the compound is single-stranded. In certain embodiments, the compound is double-stranded.

Certain embodiments provide a compound comprising a modified oligonucleotide consisting of 8 to 80 linked nucleosides and having a nucleobase sequence comprising at least 8 contiguous nucleobases of any of the nucleobase sequences of 8-2896. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 9 to 80 linked nucleosides and having a nucleobase sequence comprising at least 9 contiguous nucleobases of any of the nucleobase sequences of 8-2896. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 10 to 80 linked nucleosides and having a nucleobase sequence comprising at least 10 contiguous nucleobases of any of the nucleobase sequences of 8-2896. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 11 to 80 linked nucleosides and having a nucleobase sequence comprising at least 11 contiguous nucleobases of any of the nucleobase sequences of 8-2896. In certain embodiments, the compound is an antisense compound or oligomeric compound. In certain embodiments, the compound is single-stranded. In certain embodiments, the compound is double-stranded. In certain embodiments, the modified oligonucleotide consists of 11 to 30 linked nucleosides.

Certain embodiments provide a compound comprising a modified oligonucleotide consisting of 12 to 80 linked nucleosides and having a nucleobase sequence comprising at least 12 contiguous nucleobases of any of the nucleobase sequences of 8-2896. In certain embodiments, the compound is an antisense compound or oligomeric compound. In certain embodiments, the compound is single-stranded. In certain embodiments, the compound is double-stranded. In certain embodiments, the modified oligonucleotide consists of 12 to 30 linked nucleosides.

Certain embodiments provide a compound comprising a modified oligonucleotide consisting of 16 to 80 linked nucleosides and having a nucleobase sequence comprising the nucleobase sequence of any one of 8-2896. In certain embodiments, the compound is an antisense compound or oligomeric compound. In certain embodiments, the compound is single-stranded. In certain embodiments, the compound is double-stranded. In certain embodiments, the modified oligonucleotide consists of 16 to 30 linked nucleosides.

Certain embodiments provide a compound comprising a modified oligonucleotide having a nucleobase sequence consisting of the nucleobase sequence of any one of 8-2896. In certain embodiments, the compound is an antisense compound or oligomeric compound. In certain embodiments, the compound is single-stranded. In certain embodiments, the compound is double-stranded.

Certain embodiments provide a compound comprising a modified oligonucleotide consisting of 12 to 30 linked nucleosides and having at least an 8, 9, 10, 11, 12, 13, 14, 15, or 16 contiguous nucleobase portion complementary to an equal length portion within nucleobases 3095-3369, 3371-7564, 7565-7672, 7673-8777, 8778-8909, 8910-10401, 10402-10508, 10509-12040, 12041-12178, 12179-15641, 15642-15758, 15759-20692, or 20693-22212 of SEQ ID NO: 2, wherein said modified oligonucleotide is at least 85%, at least 90%, at least 95%, or 100% complementary to SEQ ID NO: 2. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides and having at least an 8, 9, 10, 11, 12, 13, 14, 15, or 16 contiguous nucleobase portion complementary to an equal length portion within nucleobases 1-46, 58-142, 1-142, 74-89, 154-197, 154-234, 200-232, 218-234, 240-345, 254-269, 354-746, 354-830, 519-534, 565-580, 603-628, 693-716, 734-750, 734-830, 749-828, 835-862, 835-957, 966-1044, 1017-1043, 1054-1106, 1055-1070, 1075-1169, 1074-1132, 1136-1169, 1175-1218, 1180-1217, 1250-1292, 1251-1279, 1296-1146, 1296-1448, 1308-1448, 1461-1481, 1461-1519, 1461-1647, 1461-1646, 1483-1535, 1538-1646, 1544-1561, 1597-1645, 1654-1685, 1654-1817, 1702-1817, 1705-1741, 1748-2211, 2174-2219, 2240-2272, 2244-2272, 2349-2370, 2350-2371, or 2378-2394 of an HSD17B13 nucleic acid having the nucleobase sequence of SEQ ID NO: 1.

In certain embodiments, a compound comprises a modified oligonucleotide consisting of 8 to 80 linked nucleosides and having at least an 8, 9, 10, 11, 12, 13, 14, 15, or 16 contiguous nucleobase portion complementary to an equal length portion within nucleobases 1-46, 58-142, 1-142, 74-89, 154-197, 154-234, 200-232, 218-234, 240-345, 254-269, 354-746, 354-830, 519-534, 565-580, 603-628, 693-716, 734-750, 734-830, 749-828, 835-862, 835-957, 966-1044, 1017-1043, 1054-1106, 1055-1070, 1075-1169, 1074-1132, 1136-1169, 1175-1218, 1180-1217, 1250-1292, 1251-1279, 1296-1146, 1296-1448, 1308-1448, 1461-1481, 1461-1519, 1461-1647, 1461-1646, 1483-1535, 1538-1646, 1544-1561, 1597-1645, 1654-1685, 1654-1817, 1702-1817, 1705-1741, 1748-2211, 2174-2219, 2240-2272, 2244-2272, 2349-2370, 2350-2371, or 2378-2394 of an HSD17B13 nucleic acid having the nucleobase sequence of SEQ ID NO: 1.

In certain embodiments, compounds target within nucleobases 3095-3454, 3095-3140, 3152-3236, 3168-3183, 3248-3328, 3312-3328, 3334-3390, 3348-3390, 3401-3420, 3429-3451, 3429-3454, 3474-3719, 3474-3644, 3478-3494, 3505-3531, 3544-3559, 3568-3634, 3671-3736, 3676-3717, 3721-3799, 3741-3771, 3750-3770, 3782-3799, 3834-3849, 3834-4154, 3877-3897, 3902-3917, 3933-3967, 3933-3979, 3988-4005, 3988-4017, 4068-4091, 4103-4118, 4123-4155, 4133-4155, 4220-4240, 4220-4264, 4249-4264, 4222-4240, 4296-4311, 4360-4378, 4389-4427, 4389-4431, 4405-4449, 4476-4496, 4517-4588, 4517-4552, 4537-4552, 4572-4588, 4640-4678, 4640-4879, 4641-4667, 4862-4879, 4991-5006, 4991-5305, 5029-5098, 5046-5098, 5104-5120, 5121-5141, 5125-5141, 5156-5256, 5158-5217, 5223-5242, 5267-5319, 5268-5319, 5395-5950, 5646-5695, 5655-5858, 5712-5752, 5712-5777, 5758-5777, 5782-5797, 5782-5862, 5804-5862, 5870-5910, 5871-6005, 5870-5910, 5870-5911, 5916-6007, 5935-5950, 5974-6007, 6029-6048, 6029-6055, 6035-6164, 6084-6099, 6084-6104, 6134-6164, 6170-6248, 6170-6275, 6170-6277, 6191-6218, 6221-6243, 6246-6275, 6284-6350, 6284-6352, 6298-6372, 6357-6372, 6388-6406, 6422-6493, 6422-6497, 6426-6621, 6567-6758, 6567-6582, 6597-6653, 6626-6653, 6710-6779, 6784-6811, 6785-6800, 6795-6811, 6913-6930, 6914-6929, 6914-6930, 6915-6930, 7101-7138, 7101-7441, 7125-7145, 7426-7441, 7473-7494, 7473-7498, 7481-7498, 7526-7543, 7550-7565, 7550-7634, 7563-7699, 7643-7676, 7680-7698, 7680-7699, 7708-7723, 7751-7819, 7768-7796, 7828-7866, 7834-7969, 7938-7968, 7938-7969, 7973-7994, 8017-8032, 8039-8186, 8039-8065, 8040-8065, 8121-8156, 8125-8151, 8164-8185, 8164-8186, 8205-8297, 8205-8220, 8236-8252, 8236-8271, 8256-8294, 8279-8297, 8487-8502, 8487-8627, 8529-8579, 8587-8628, 8636-8732, 8643-8910, 8744-8762, 8786-8910, 8939-9027, 8939-8996, 9000-9027, 9057-9096, 9080-9230, 9110-9173, 9188-9240, 9256-9275, 9312-9365, 9372-9401, 9373-9394, 9410-9446, 9410-9491, 9476-9555, 9497-9555, 9588-9678, 9588-9681, 9712-9737, 9712-9742, 9751-9811, 9751-10040, 9887-9902, 9908-10017, 10025-10040, 10058-10079, 10112-10160, 10124-10160, 10138-10160, 10180-10227, 10180-10233, 10258-10279, 10292-10310, 10293-10310, 10335-10375, 10335-10538, 10380-10538, 10554-10569, 10584-10599, 10728-10745, 10831-10870, 10930-10946, 10931-10946, 10970-10993, 10971-11015, 1100-11015, 11030-11045, 11073-11094, 11074-11094, 11115-11132, 11117-11132, 11155-11171, 11210-11228, 11210-11276, 11235-11276, 11290-11323, 11308-11323, 11384-11407, 11385-11443, 11428-11443, 11468-11529, 11542-11605, 11621-11636, 11621-11638, 11621-11668, 11652-11668, 11742-11808, 11742-11811, 11853-11881, 11853-11909, 11892-11912, 11924-11940, 11925-12226, 11953-12027, 12038-12226, 12238-12270, 12337-12531, 12337-12368, 12410-12448, 12465-12531, 12598-12642, 12598-12742, 12647-12742, 12758-12832, 12761-12832, 12862-12904, 13548-13627, 13551-13654, 13638-13674, 13688-13798, 13704-13798, 13813-13932, 13949-14064, 13951-13969, 13975-14064, 14077-14107, 14089-14107, 14126-14147, 14165-14221, 14166-14221, 14243-14298, 14243-14299, 14315-14336, 14316-14336, 14362-14414, 14432-14454, 14461-14514, 14465-14514, 14541-14815, 14541-14636, 14724-14746, 1400-14815, 14905-14951, 14916-14951, 15019-15039, 15022-15039, 15170-15185, 15200-15232, 15211-15268, 15244-15268, 15279-15295, 15279-15399, 15312-15343, 15350-15399, 15405-15460, 15492-15526, 15570-15586, 15633-15808, 15641-15657, 15643-15711, 15716-15765, 15771-15802, 16116-16144, 16116-16149, 16189-16206, 16189-16342, 16218-16240, 16254-16310, 16327-16352, 16377-16397, 16377-16400, 16407-16439, 16407-16440, 16461-16476, 16533-16548, 16755-16770, 16895-16920, 16905-16920, 16956-16984, 16956-17092, 17014-17034, 17135-17159, 17041-17062, 17077-17092, 17135-17159, 17227-17254, 17672-17795, 17675-17872, 17802-17817, 17857-17872, 17909-17945, 17909-17971, 17953-17971, 17954-17971, 17984-18061, 17985-18048, 18075-18117, 18087-18115, 18138-18160, 18176-18193, 18505-18555, 18506-18536, 18585-18600, 18658-18712, 18662-18762, 18720-18763, 18798-18864, 18871-18888, 18901-18940, 18925-18940, 18958-18983, 18958-19013, 19388-19460, 19467-19513, 19474-19505, 19531-19626, 19533-19626, 19649-19717, 19649-19726, 19731-19801, 19731-19842, 19815-19875, 19860-19951, 19887-19951, 19970-19985, 19970-20054, 19999-20024, 20037-20061, 20087-20102, 20109-20153, 20087-20207, 20172-20212, 20356-20438, 20248-20437, 20248-20264, 20470-20508, 20481-20507, 20571-20623, 20571-20644, 20685-20700, 20706-21032, 20706-20772, 20781-20859, 20869-20984, 20990-21033, 21065-21102, 21065-21263, 21092-21632, 21276-21500, 21517-21632, 21989-22034, 22059-22087, or 22164-22209 of an HSD17B13 nucleic acid having the nucleobase sequence of SEQ ID NO: 2.

In certain embodiments, compounds have at least an 8, 9, 10, 11, 12, 13, 14, 15, or 16 contiguous nucleobase portion complementary to an equal length portion within nucleobases 3095-3454, 3095-3140, 3152-3236, 3168-3183, 3248-3328, 3312-3328, 3334-3390, 3348-3390, 3401-3420, 3429-3451, 3429-3454, 3474-3719, 3474-3644, 3478-3494, 3505-3531, 3544-3559, 3568-3634, 3671-3736, 3676-3717, 3721-3799, 3741-3771, 3750-3770, 3782-3799, 3834-3849, 3834-4154, 3877-3897, 3902-3917, 3933-3967, 3933-3979, 3988-4005, 3988-4017, 4068-4091, 4103-4118, 4123-4155, 4133-4155, 4220-4240, 4220-4264, 4249-4264, 4222-4240, 4296-4311, 4360-4378, 4389-4427, 4389-4431, 4405-4449, 4476-4496, 4517-4588, 4517-4552, 4537-4552, 4572-4588, 4640-4678, 4640-4879, 4641-4667, 4862-4879, 4991-5006, 4991-5305, 5029-5098, 5046-5098, 5104-5120, 5121-5141, 5125-5141, 5156-5256, 5158-5217, 5223-5242, 5267-5319, 5268-5319, 5395-5950, 5646-5695, 5655-5858, 5712-5752, 5712-5777, 5758-5777, 5782-5797, 5782-5862, 5804-5862, 5870-5910, 5871-6005, 5870-5910, 5870-5911, 5916-6007, 5935-5950, 5974-6007, 6029-6048, 6029-6055, 6035-6164, 6084-6099, 6084-6104, 6134-6164, 6170-6248, 6170-6275, 6170-6277, 6191-6218, 6221-6243, 6246-6275, 6284-6350, 6284-6352, 6298-6372, 6357-6372, 6388-6406, 6422-6493, 6422-6497, 6426-6621, 6567-6758, 6567-6582, 6597-6653, 6626-6653, 6710-6779, 6784-6811, 6785-6800, 6795-6811, 6913-6930, 6914-6929, 6914-6930, 6915-6930, 7101-7138, 7101-7441, 7125-7145, 7426-7441, 7473-7494, 7473-7498, 7481-7498, 7526-7543, 7550-7565, 7550-7634, 7563-7699, 7643-7676, 7680-7698, 7680-7699, 7708-7723, 7751-7819, 7768-7796, 7828-7866, 7834-7969, 7938-7968, 7938-7969, 7973-7994, 8017-8032, 8039-8186, 8039-8065, 8040-8065, 8121-8156, 8125-8151, 8164-8185, 8164-8186, 8205-8297, 8205-8220, 8236-8252, 8236-8271, 8256-8294, 8279-8297, 8487-8502, 8487-8627, 8529-8579, 8587-8628, 8636-8732, 8643-8910, 8744-8762, 8786-8910, 8939-9027, 8939-8996, 9000-9027, 9057-9096, 9080-9230, 9110-9173, 9188-9240, 9256-9275, 9312-9365, 9372-9401, 9373-9394, 9410-9446, 9410-9491, 9476-9555, 9497-9555, 9588-9678, 9588-9681, 9712-9737, 9712-9742, 9751-9811, 9751-10040, 9887-9902, 9908-10017, 10025-10040, 10058-10079, 10112-10160, 10124-10160, 10138-10160, 10180-10227, 10180-10233, 10258-10279, 10292-10310, 10293-10310, 10335-10375, 10335-10538, 10380-10538, 10554-10569, 10584-10599, 10728-10745, 10831-10870, 10930-10946, 10931-10946, 10970-10993, 10971-11015, 1100-11015, 11030-11045, 11073-11094, 11074-11094, 11115-11132, 11117-11132, 11155-11171, 11210-11228, 11210-11276, 11235-

11276, 11290-11323, 11308-11323, 11384-11407, 11385-11443, 11428-11443, 11468-11529, 11542-11605, 11621-11636, 11621-11638, 11621-11668, 11652-11668, 11742-11808, 11742-11811, 11853-11881, 11853-11909, 11892-11912, 11924-11940, 11925-12226, 11953-12027, 12038-12226, 12238-12270, 12337-12531, 12337-12368, 12410-12448, 12465-12531, 12598-12642, 12598-12742, 12647-12742, 12758-12832, 12761-12832, 12862-12904, 13548-13627, 13551-13654, 13638-13674, 13688-13798, 13704-13798, 13813-13932, 13949-14064, 13951-13969, 13975-14064, 14077-14107, 14089-14107, 14126-14147, 14165-14221, 14166-14221, 14243-14298, 14243-14299, 14315-14336, 14316-14336, 14362-14414, 14432-14454, 14461-14514, 14465-14514, 14541-14815, 14541-14636, 14724-14746, 1400-14815, 14905-14951, 14916-14951, 15019-15039, 15022-15039, 15170-15185, 15200-15232, 15211-15268, 15244-15268, 15279-15295, 15279-15399, 15312-15343, 15350-15399, 15405-15460, 15492-15526, 15570-15586, 15633-15808, 15641-15657, 15643-15711, 15716-15765, 15771-15802, 16116-16144, 16116-16149, 16189-16206, 16189-16342, 16218-16240, 16254-16310, 16327-16352, 16377-16397, 16377-16400, 16407-16439, 16407-16440, 16461-16476, 16533-16548, 16755-16770, 16895-16920, 16905-16920, 16956-16984, 16956-17092, 17014-17034, 17135-17159, 17041-17062, 17077-17092, 17135-17159, 17227-17254, 17672-17795, 17675-17872, 17802-17817, 17857-17872, 17909-17945, 17909-17971, 17953-17971, 17954-17971, 17984-18061, 17985-18048, 18075-18117, 18087-18115, 18138-18160, 18176-18193, 18505-18555, 18506-18536, 18585-18600, 18658-18712, 18662-18762, 18720-18763, 18798-18864, 18871-18888, 18901-18940, 18925-18940, 18958-18983, 18958-19013, 19388-19460, 19467-19513, 19474-19505, 19531-19626, 19533-19626, 19649-19717, 19649-19726, 19731-19801, 19731-19842, 19815-19875, 19860-19951, 19887-19951, 19970-19985, 19970-20054, 19999-20024, 20037-20061, 20087-20102, 20109-20153, 20087-20207, 20172-20212, 20356-20438, 20248-20437, 20248-20624, 20470-20508, 20481-20507, 20571-20623, 20571-20644, 20685-20700, 20706-21032, 20706-20772, 20781-20859, 20869-20984, 20990-21033, 21065-21102, 21065-21263, 21092-21632, 21276-21500, 21517-21632, 21989-22034, 22059-22087, or 22164-22209 of an HSD17B13 nucleic acid having the nucleobase sequence of SEQ ID NO: 2. In certain embodiments, these compounds are antisense compounds, oligomeric compounds, or oligonucleotides. In certain embodiments, the modified oligonucleotide consists of 10 to 30 linked nucleosides. In certain embodiments, the modified oligonucleotide consists of 16 to 30 linked nucleosides.

In certain embodiments, compounds have a nucleobase sequence complementary to nucleobases 1323-1338, 1600-1615, 1627-1642, or 1782-1797 of an HSD17B13 nucleic acid having the nucleobase sequence of SEQ ID NO: 1.

In certain embodiments, compounds have a nucleobase sequence comprising a portion of at least 8, 9, 10, 11, 12, 13, 14, 15, or 16 contiguous nucleobases complementary within an equal length portion of nucleobases 1323-1338, 1600-1615, 1627-1642, or 1782-1797 of an HSD17B13 nucleic acid having the nucleobase sequence of SEQ ID NO: 1. In certain embodiments, these compounds are antisense compounds, oligomeric compounds, or oligonucleotides. In certain embodiments, the modified oligonucleotide consists of 10 to 30 linked nucleosides. In certain embodiments, the modified oligonucleotide consists of 16 to 30 linked nucleosides.

In certain embodiments, compounds have a nucleobase sequence complementary to nucleobases 3439-3454, 3552-3567, 3754-3769, 3963-3978, 4406-4421, 4123-4138, 4139-4154, 4991-5006, 5045-5060, 5662-5677, 6476-6491, 6478-6493, 17992-18007, 21138-21153, 21415-21430, 21442-21457, or 21597-21612 of an HSD17B13 nucleic acid having the nucleobase sequence of SEQ ID NO: 2.

In certain embodiments, compounds have a nucleobase sequence comprising a portion of at least 8, 9, 10, 11, 12, 13, 14, 15, or 16 contiguous nucleobases complementary within an equal length portion of nucleobases 3439-3454, 3552-3567, 3754-3769, 3963-3978, 4406-4421, 4123-4138, 4139-4154, 4991-5006, 5045-5060, 5662-5677, 6476-6491, 6478-6493, 17992-18007, 21138-21153, 21415-21430, 21442-21457, or 21597-21612 of an HSD17B13 nucleic acid having the nucleobase sequence of SEQ ID NO: 2. In certain embodiments, these compounds are antisense compounds, oligomeric compounds, or oligonucleotides. In certain embodiments, the modified oligonucleotide consists of 10 to 30 linked nucleosides. In certain embodiments, the modified oligonucleotide consists of 16 to 30 linked nucleosides.

In certain embodiments, any of the foregoing modified oligonucleotides has at least one modified internucleoside linkage, at least one modified sugar, and/or at least one modified nucleobase.

In certain embodiments, at least one nucleoside of any of the foregoing modified oligonucleotides comprises a modified sugar. In certain embodiments, the modified sugar comprises a 2'-O-methoxyethyl group. In certain embodiments, the modified sugar is a bicyclic sugar, such as a 4'-CH(CH3)-O-2' group, a 4'-CH2-O-2' group, or a 4'-(CH2)$_2$—O-2' group.

In certain embodiments, at least one internucleoside linkage of the modified oligonucleotide comprises a modified internucleoside linkage, such as a phosphorothioate internucleoside linkage.

In certain embodiments, at least one nucleobase of any of the foregoing modified oligonucleotides comprises a modified nucleobase, such as 5-methylcytosine.

In certain embodiments, any of the foregoing modified oligonucleotides has:
 a gap segment consisting of linked deoxynucleosides;
 a 5' wing segment consisting of linked nucleosides; and
 a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide consists of 12 to 30 linked nucleosides and has a nucleobase sequence comprising the sequence recited in any one of SEQ ID NOs: 8-2896. In certain embodiments, the modified oligonucleotide is 16 to 30 linked nucleosides in length having a nucleobase sequence comprising the nucleobase sequence recited in any one of SEQ ID NOs: 8-2896. In certain embodiments, the modified oligonucleotide is 16 linked nucleosides in length having a nucleobase sequence consisting of the sequence recited in any one of SEQ ID NOs: 8-2896.

In certain embodiments, a compound comprises or consists of a modified oligonucleotide consisting of 16 to 80 linked nucleobases and having a nucleobase sequence comprising the nucleobase sequence recited in any one of 8-2896, wherein the modified oligonucleotide has:

a gap segment consisting of linked 2'-deoxynucleosides;

a 5' wing segment consisting of linked nucleosides; and a 3' wing segment consisting of linked nucleosides;

wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides In certain embodiments, a compound comprises or consists of a modified oligonucleotide 12-30 linked nucleobases in length having a nucleobase sequence comprising the sequence recited in any one of SEQ ID NOs: 286, 817, 983, 1215, 747, 43, 355, 1602, 201, 734, 1249, 208, 513, 1449, 1448, and 1595, wherein the modified oligonucleotide has:

a gap segment consisting of ten linked 2'-deoxynucleosides;

a 5' wing segment consisting of three linked nucleosides; and a 3' wing segment consisting of three linked nucleosides;

wherein the gap segment is positioned between the 5' wing segment and the 3' wing segment, wherein each nucleoside of each wing segment comprises a cEt sugar; wherein each internucleoside linkage is a phosphorothioate linkage and wherein each cytosine is a 5-methylcytosine. In certain embodiments, the modified oligonucleotide consists of 16-30 linked nucleosides. In certain embodiments, the modified oligonucleotide consists of 16 linked nucleosides.

In certain embodiments, a compound comprises or consists of a modified oligonucleotide 12-30 linked nucleobases in length having a nucleobase sequence comprising the sequence recited in any one of SEQ ID NOs: 819, wherein the modified oligonucleotide has:

a gap segment consisting of nine linked 2'-deoxynucleosides;

a 5' wing segment consisting of three linked nucleosides; and a 3' wing segment consisting of four linked nucleosides;

wherein the gap segment is positioned between the 5' wing segment and the 3' wing segment, wherein each nucleoside of the 5' wing segment comprises a cEt sugar; wherein the sugar residues of the nucleosides of the 3' wing segment are 5'-cEt-cEt-cEt-MOE-3'; wherein each internucleoside linkage is a phosphorothioate linkage and wherein each cytosine is a 5-methylcytosine. In certain embodiments, the modified oligonucleotide consists of 16-30 linked nucleosides. In certain embodiments, the modified oligonucleotide consists of 16 linked nucleosides.

In certain embodiments, a compound comprises or consists of a modified oligonucleotide 12-30 linked nucleobases in length having a nucleobase sequence comprising the sequence recited in any one of SEQ ID NOs: 1595, wherein the modified oligonucleotide has:

a gap segment consisting of ten linked nucleosides;

a 5' wing segment consisting of three linked nucleosides; and a 3' wing segment consisting of four linked nucleosides;

wherein the gap segment is positioned between the 5' wing segment and the 3' wing segment and wherein the gap segment consists of 5'-one deoxy, one 2'-O-methyl nucleoside, and eight deoxynucleosides-3', wherein each nucleoside of each of the wing segments comprises a cEt sugar; wherein each internucleoside linkage is a phosphorothioate linkage and wherein each cytosine is a 5-methylcytosine. In certain embodiments, the modified oligonucleotide consists of 16-30 linked nucleosides. In certain embodiments, the modified oligonucleotide consists of 16 linked nucleosides.

In any of the foregoing embodiments, the compound or oligonucleotide can be at least 85%, at least 90%, at least 95%, at least 98%, at least 99%, or 100% complementary to a nucleic acid encoding HSD17B13.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can consist of 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides. In certain embodiments, the compound comprises or consists of an oligonucleotide.

In certain embodiments, a compound comprises a modified oligonucleotide described herein and a conjugate group. In certain embodiments, the conjugate group is linked to the modified oligonucleotide at the 5' end of the modified oligonucleotide. In certain embodiments, the conjugate group is linked to the modified oligonucleotide at the 3' end of the modified oligonucleotide. In certain embodiments, the conjugate group comprises at least one N-Acetylgalactosamine (GalNAc), at least two N-Acetylgalactosamines (GalNAcs), or at least three N-Acetylgalactosamines (GalNAcs).

In certain embodiments, compounds or compositions provided herein comprise a pharmaceutically acceptable salt of the modified oligonucleotide. In certain embodiments, the salt is a sodium salt. In certain embodiments, the salt is a potassium salt.

In certain embodiments, a compound provided herein is according to the following chemical structure:
(SEQ ID NO: 286)
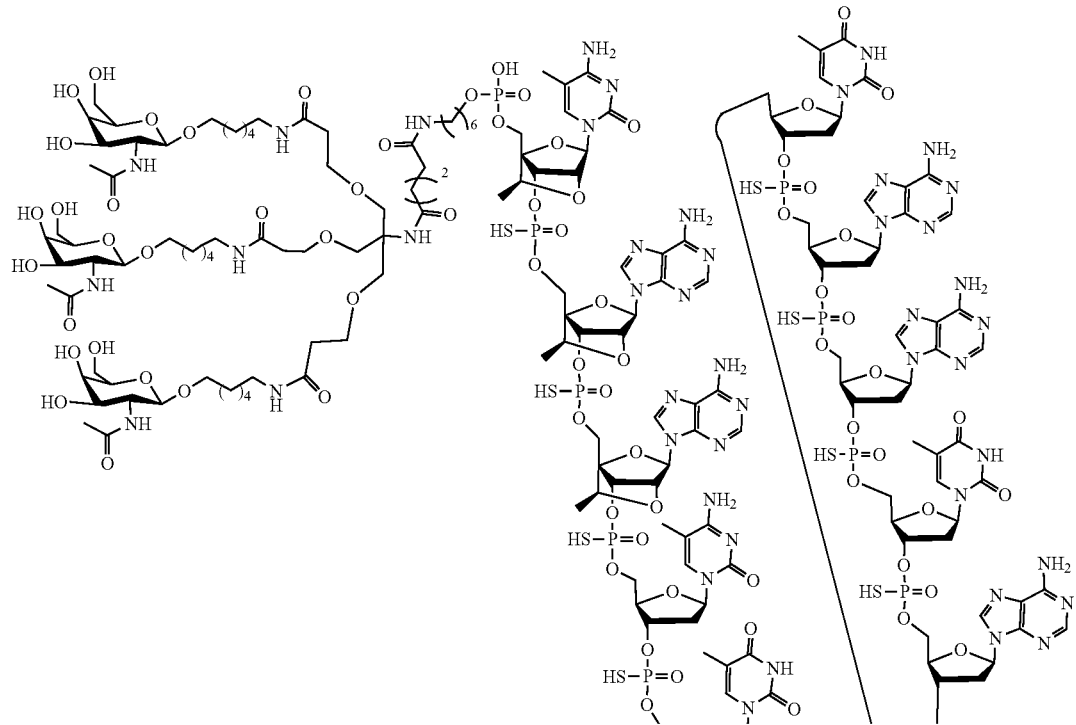
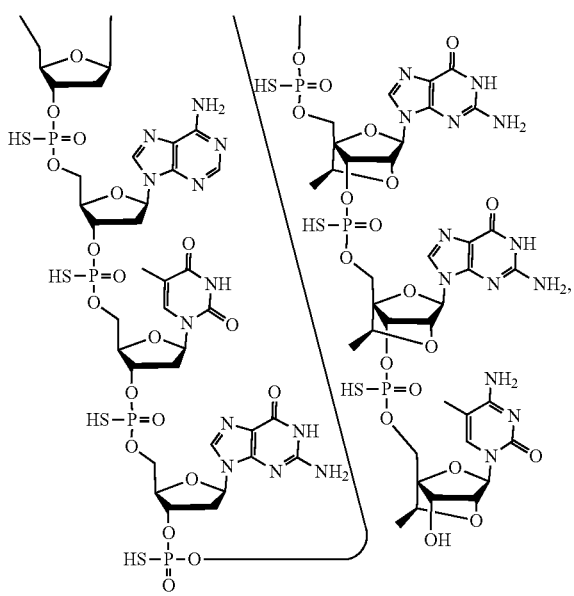
or a salt thereof. In certain embodiments, the compound is a sodium salt. In certain embodiments, the compound is a potassium salt.

In certain embodiments, a compound provided herein is according to the following chemical structure:
(SEQ ID NO: 286)
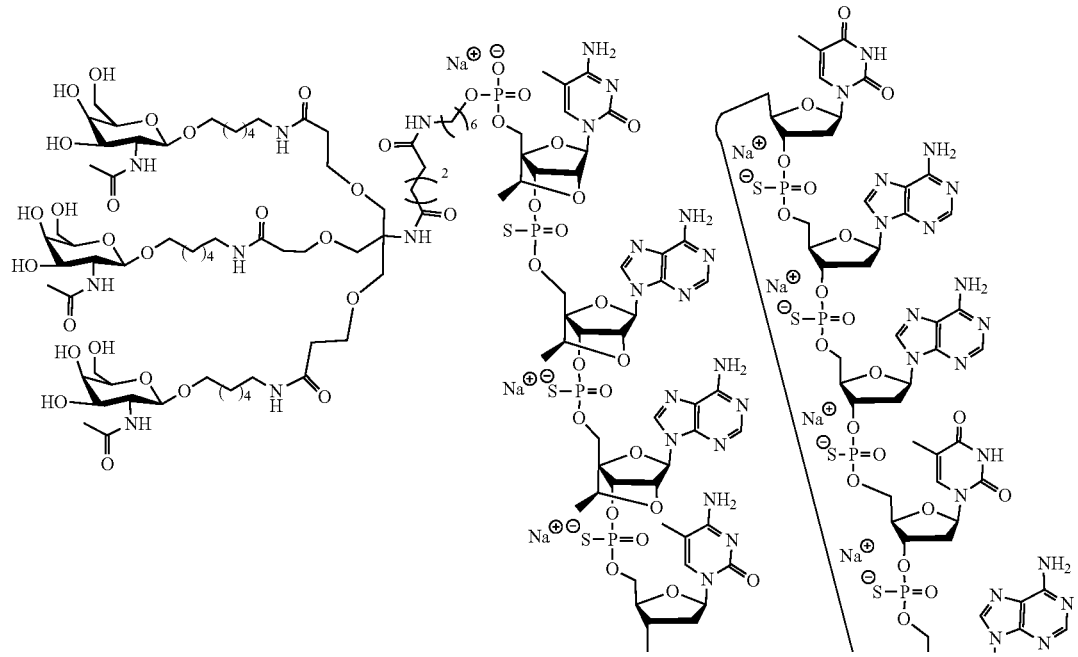
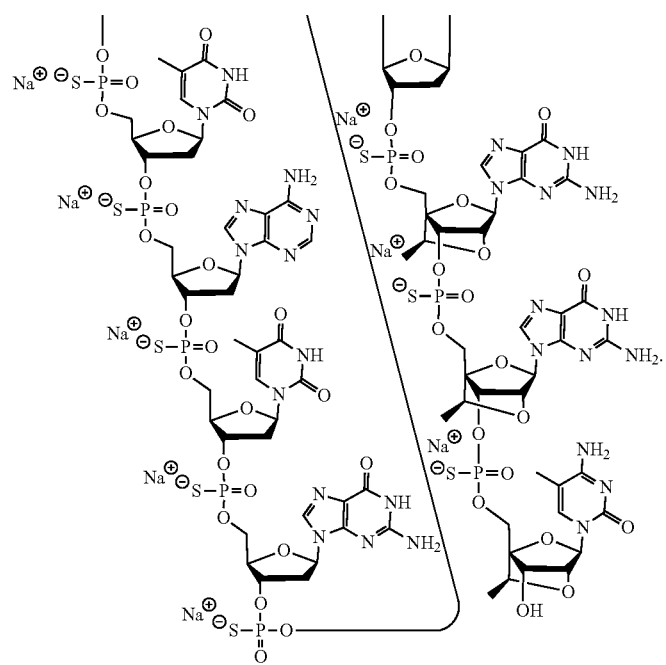

In certain embodiments, a compound provided herein is according to the following chemical structure:
(SEQ ID NO: 817)
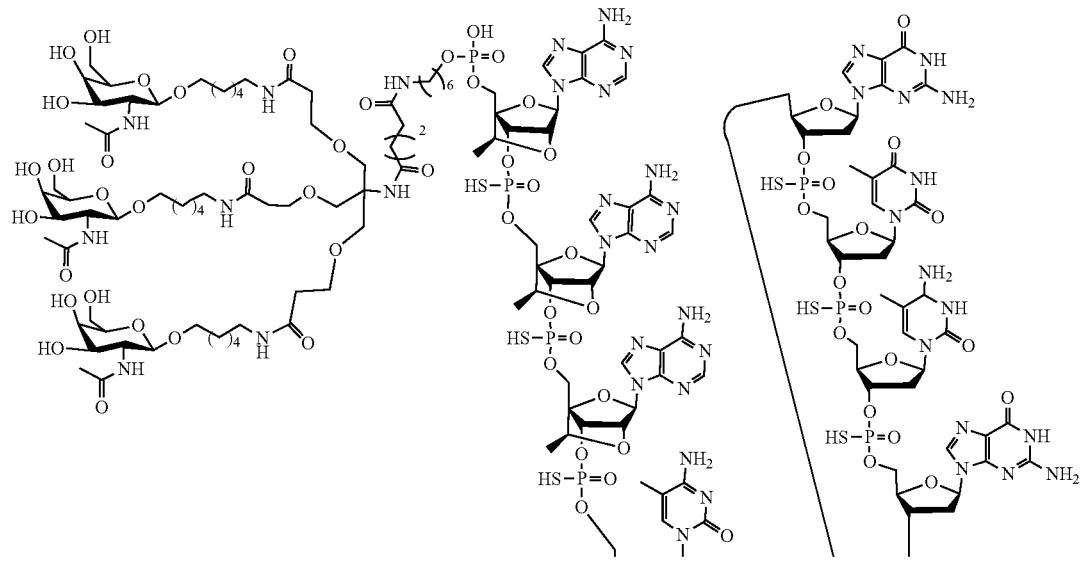
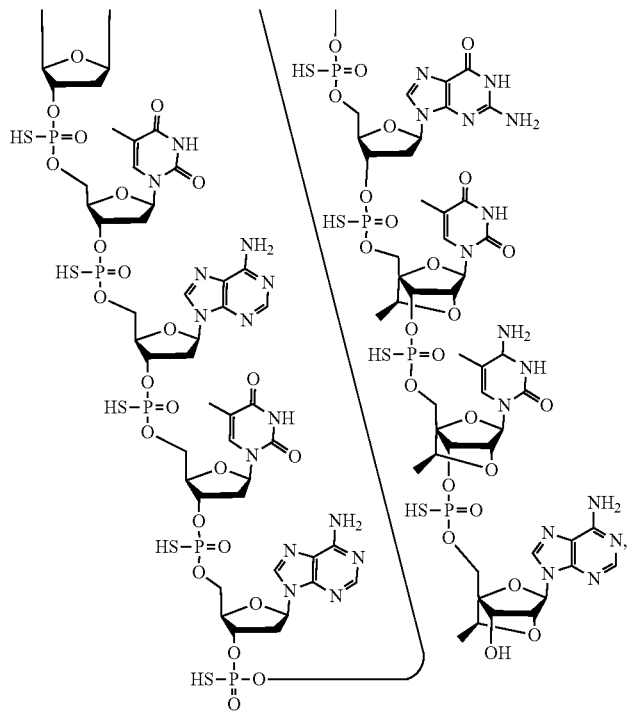
or a salt thereof. In certain embodiments, the compound is a sodium salt. In certain embodiments, the compound is a potassium salt.

In certain embodiments, a compound provided herein is according to the following chemical structure:
(SEQ ID NO: 817)
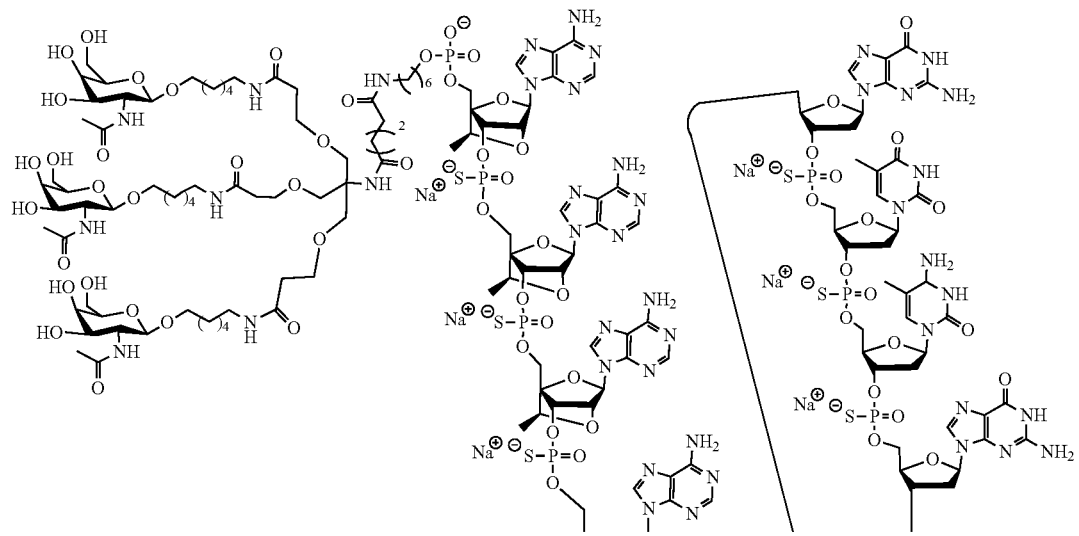
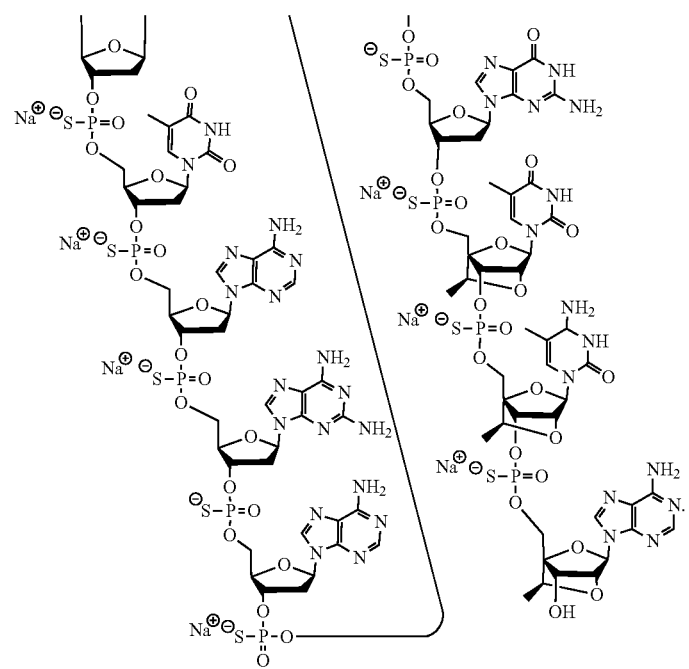

In certain embodiments, a compound provided herein is according to the following chemical structure:
(SEQ ID NO: 983)
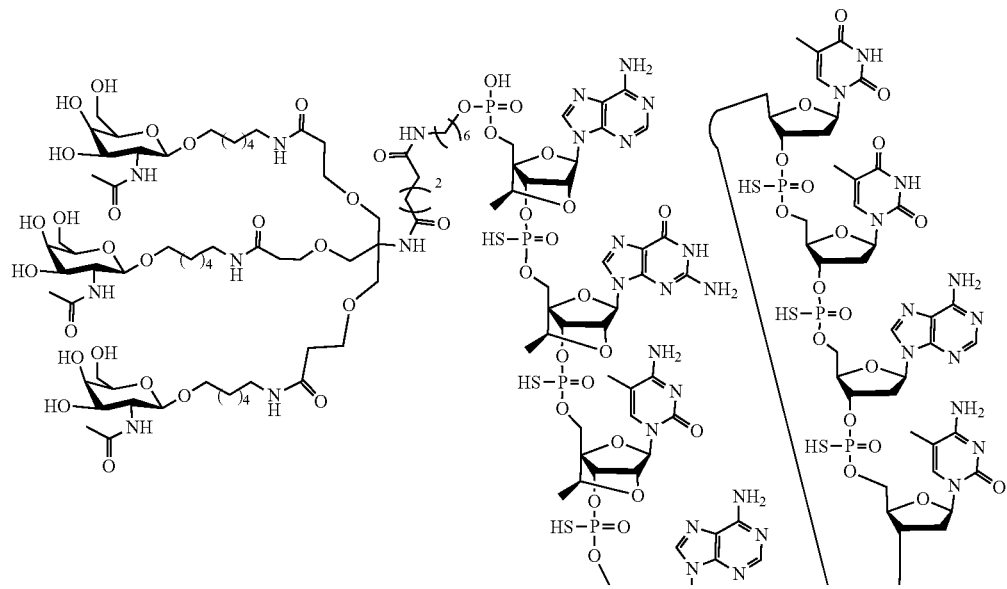
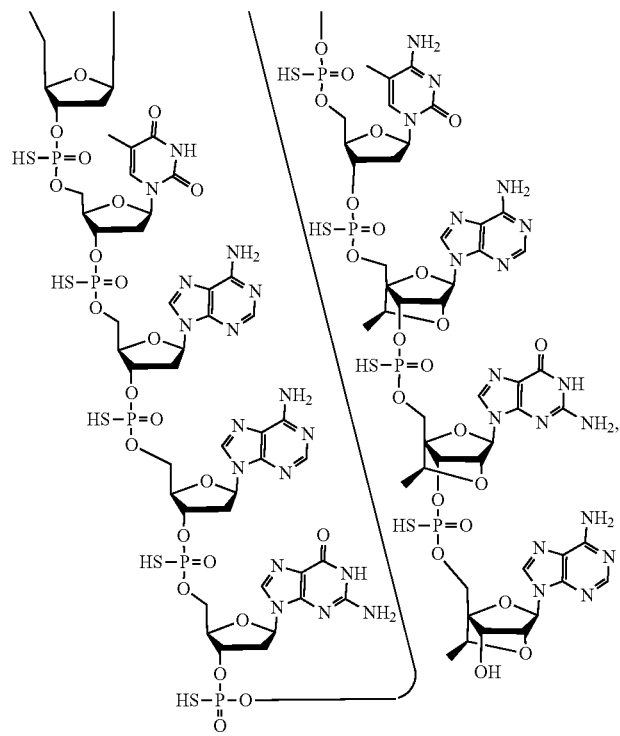
or a salt thereof. In certain embodiments, the compound is a sodium salt. In certain embodiments, the compound is a potassium salt.

In certain embodiments, a compound provided herein is according to the following chemical structure:
(SEQ ID NO: 983)
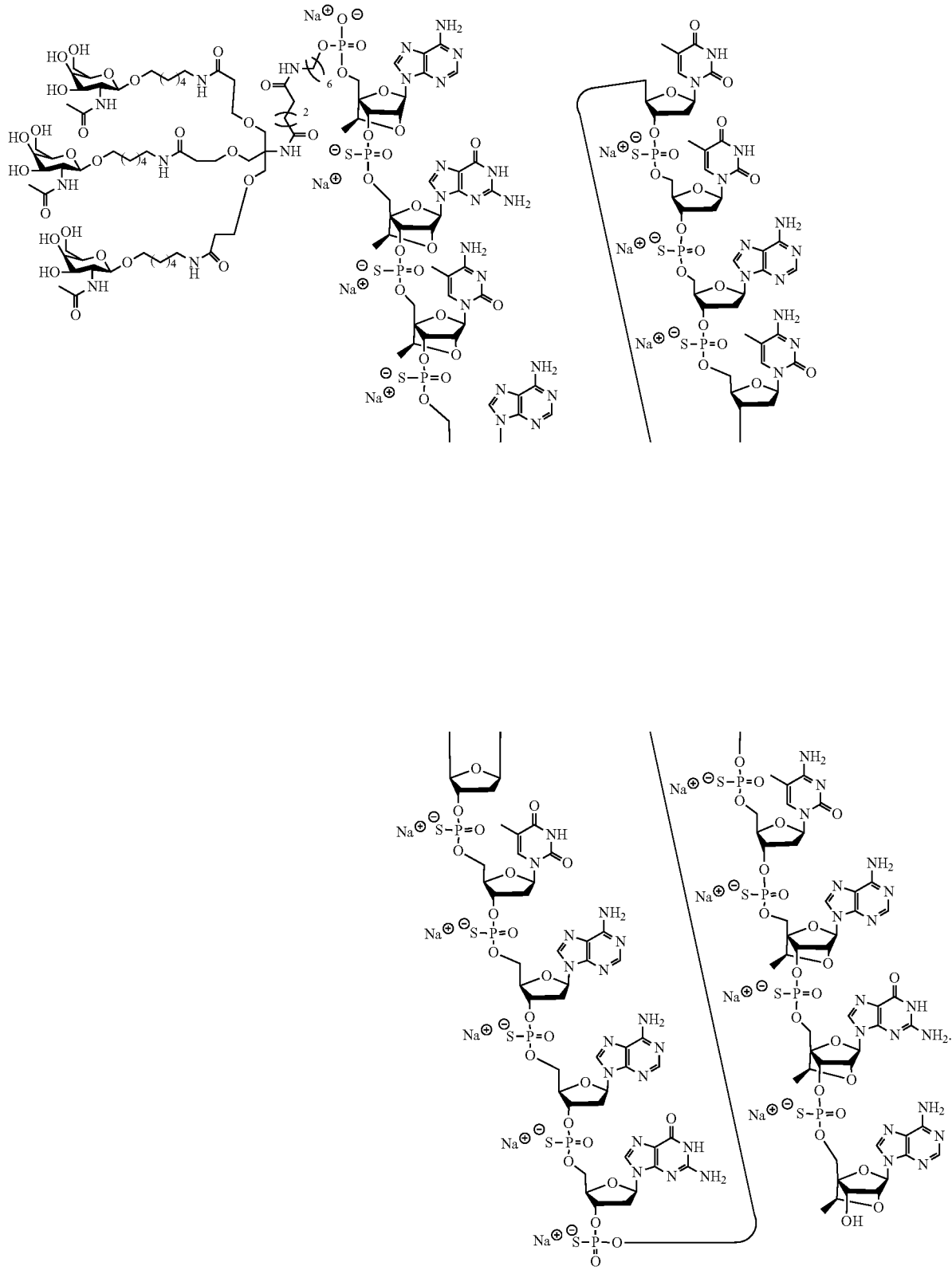

In certain embodiments, a compound provided herein is according to the following chemical structure:
(SEQ ID NO: 1215)
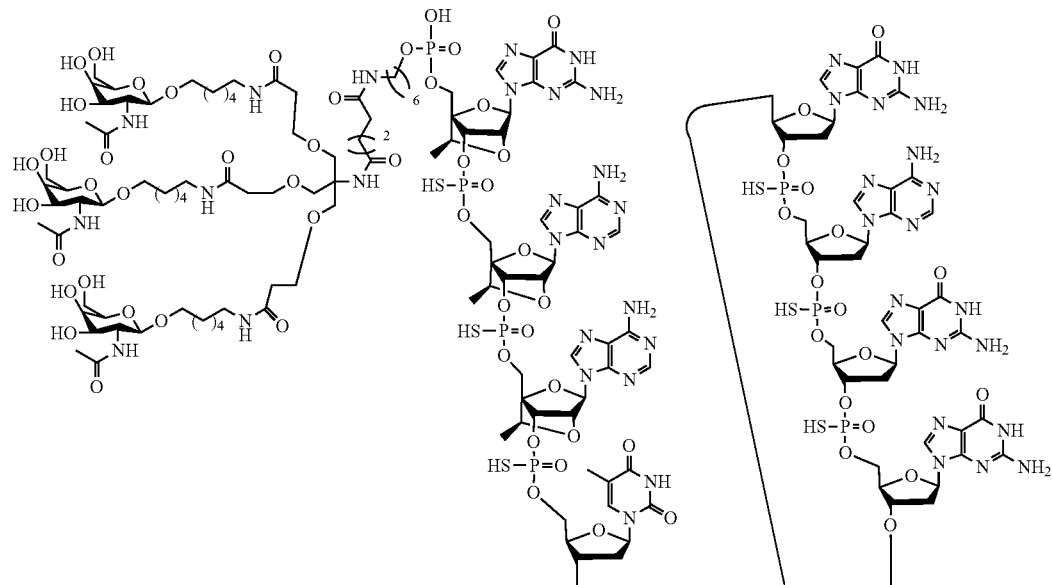
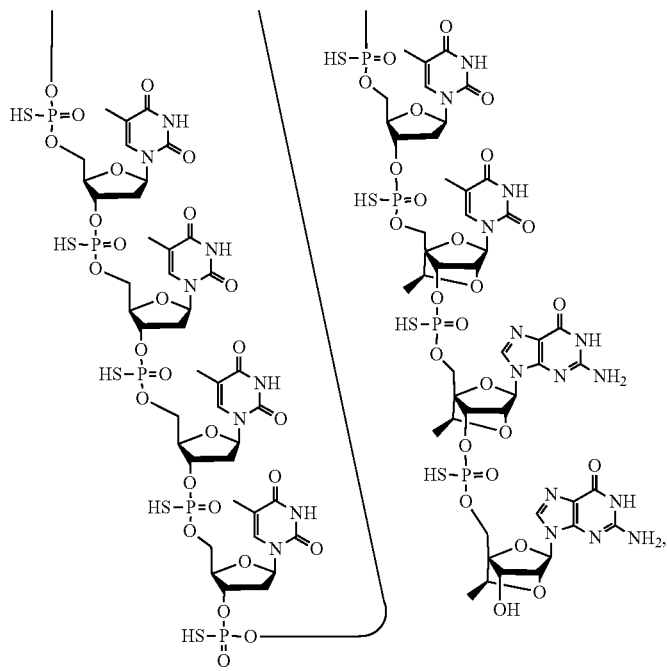
or a salt thereof. In certain embodiments, the compound is a sodium salt. In certain embodiments, the compound is a potassium salt.

In certain embodiments, a compound provided herein is according to the following chemical structure:
(SEQ ID NO: 1215)
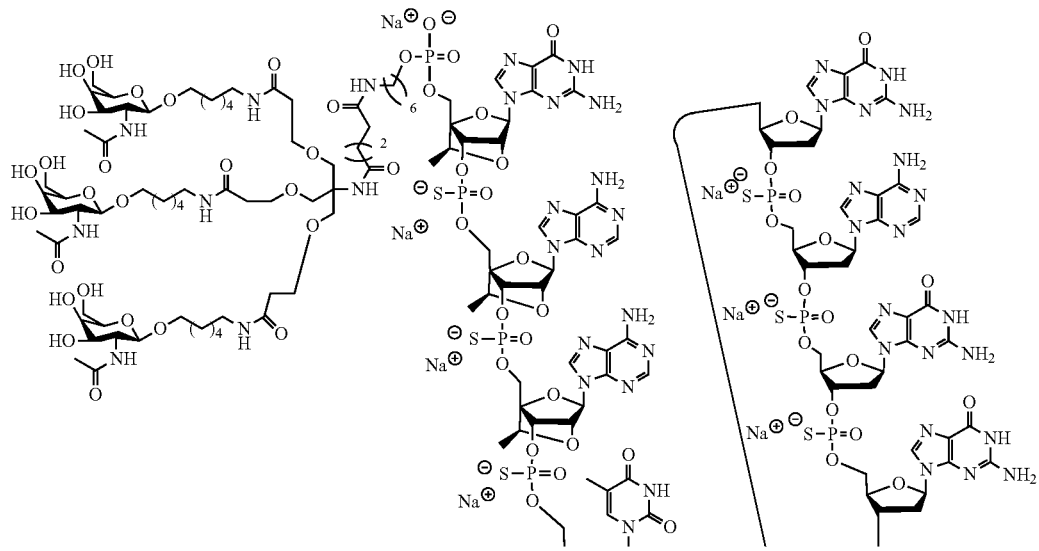
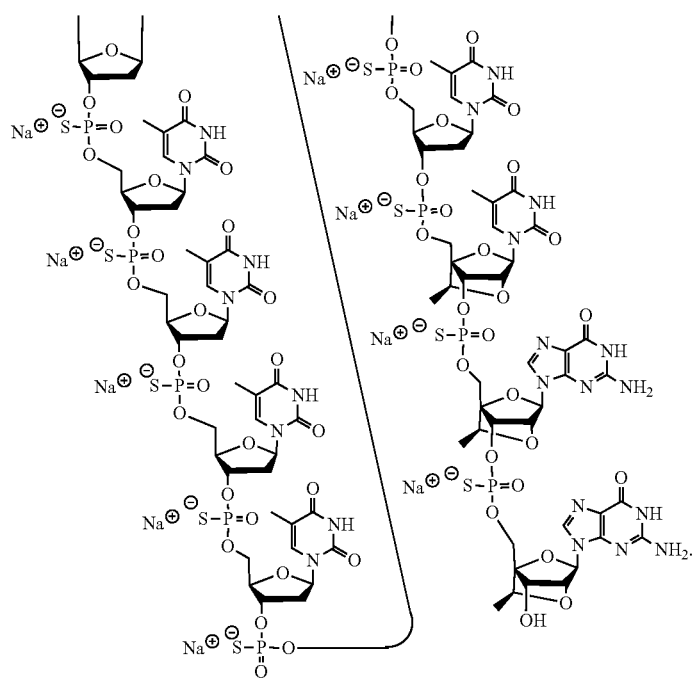

In certain embodiments, a compound provided herein is according to the following chemical structure:
(SEQ ID NO: 747)
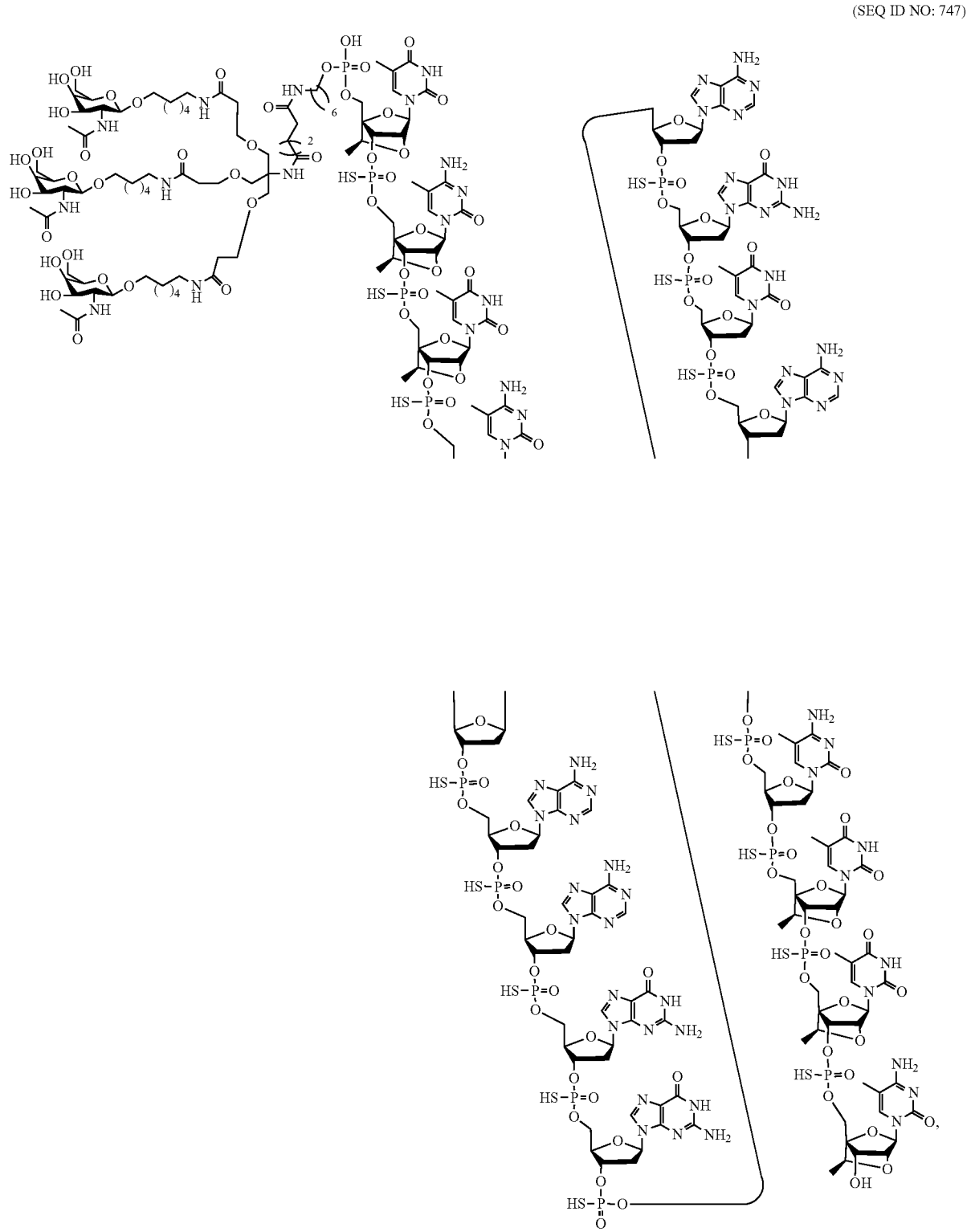
or a salt thereof. In certain embodiments, the compound is a sodium salt. In certain embodiments, the compound is a potassium salt.

In certain embodiments, a compound provided herein is according to the following chemical structure:
(SEQ ID NO: 747)
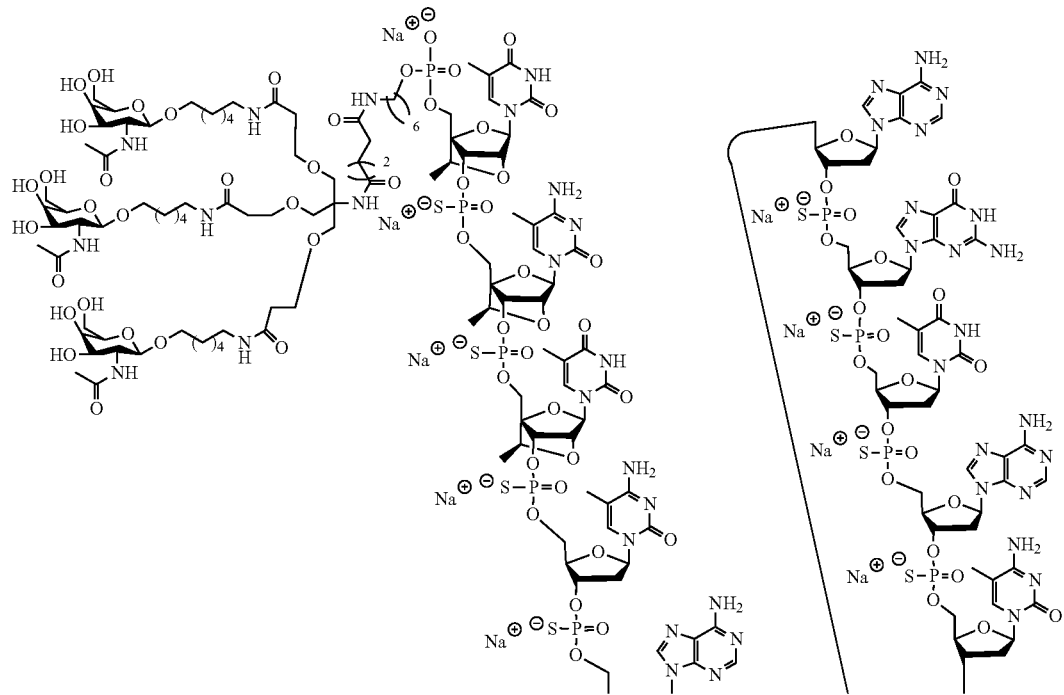
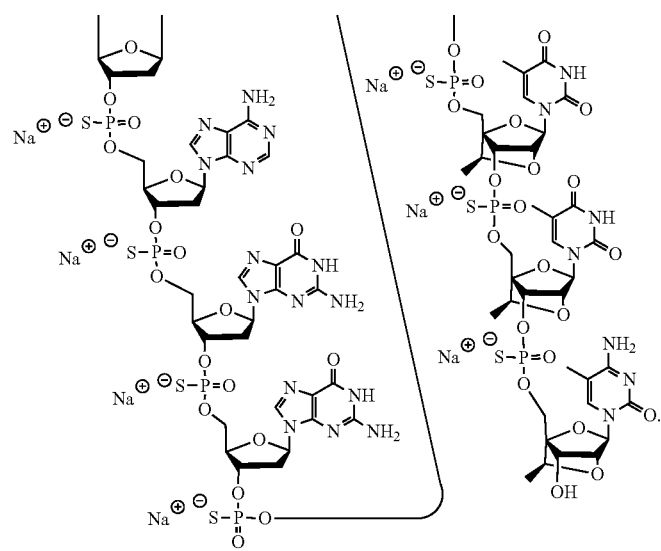

In certain embodiments, a compound provided herein is according to the following chemical structure:
(SEQ ID NO: 43)
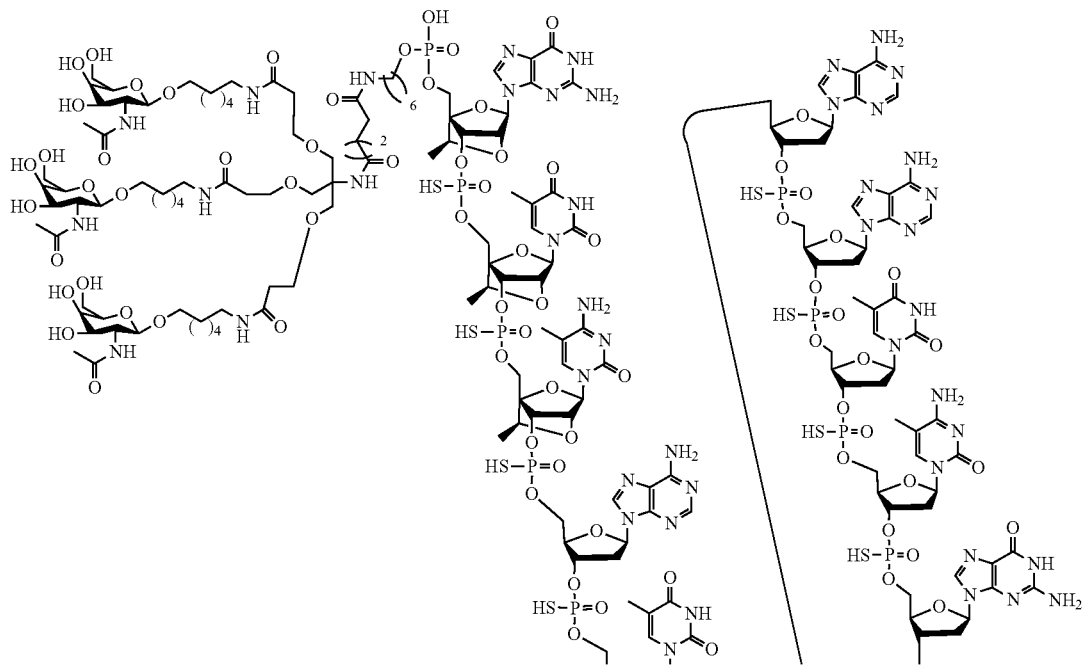
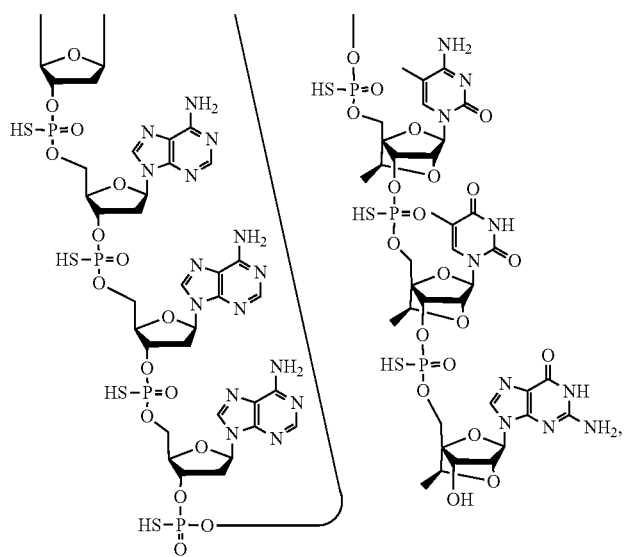
or a salt thereof. In certain embodiments, the compound is a sodium salt. In certain embodiments, the compound is a potassium salt.

In certain embodiments, a compound provided herein is according to the following chemical structure:
(SEQ ID NO: 43)
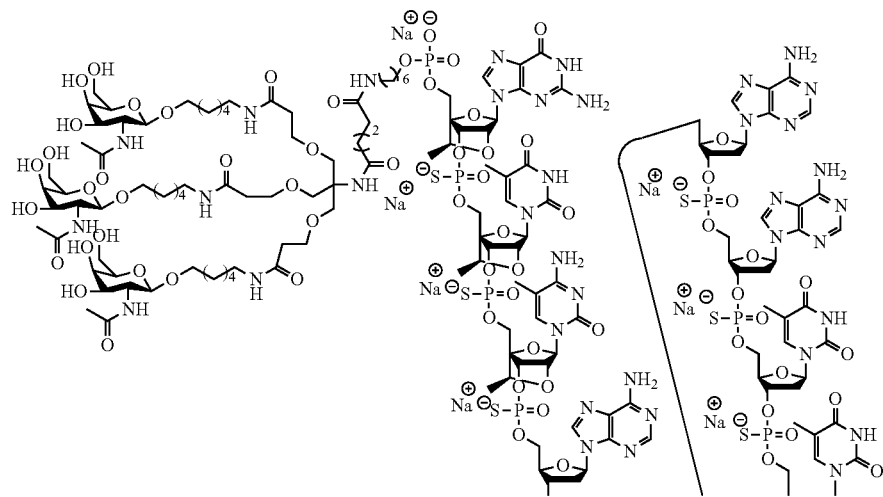
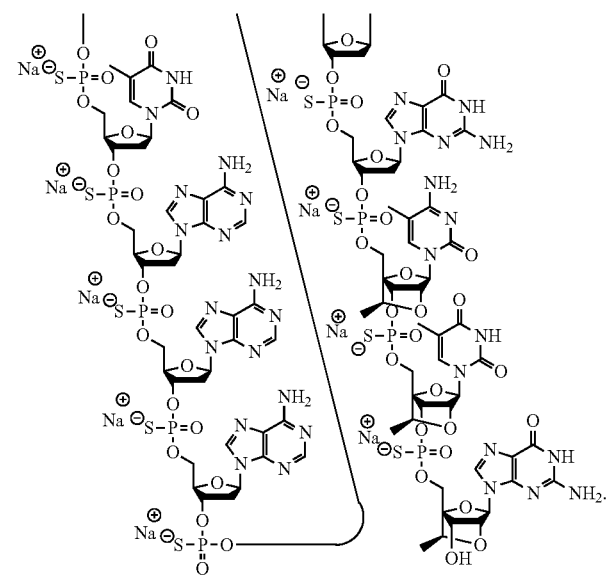

In certain embodiments, a compound provided herein is according to the following chemical structure:
(SEQ ID NO: 355)
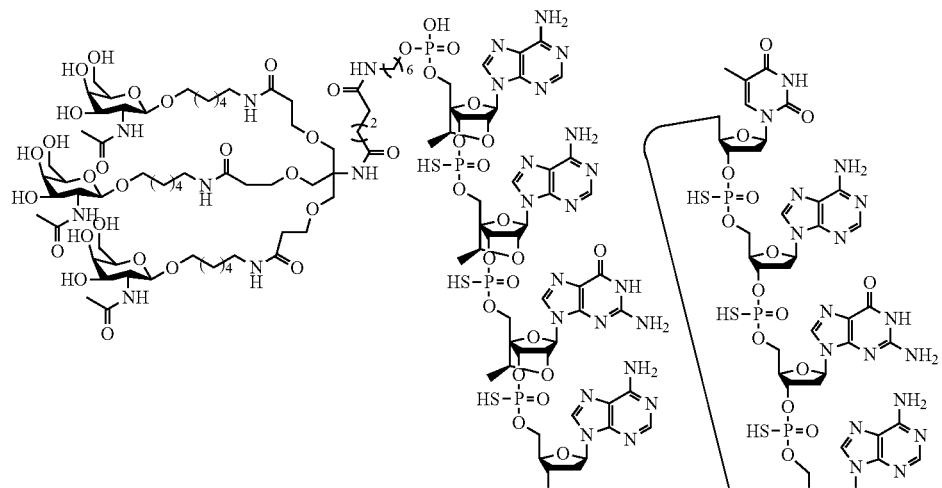
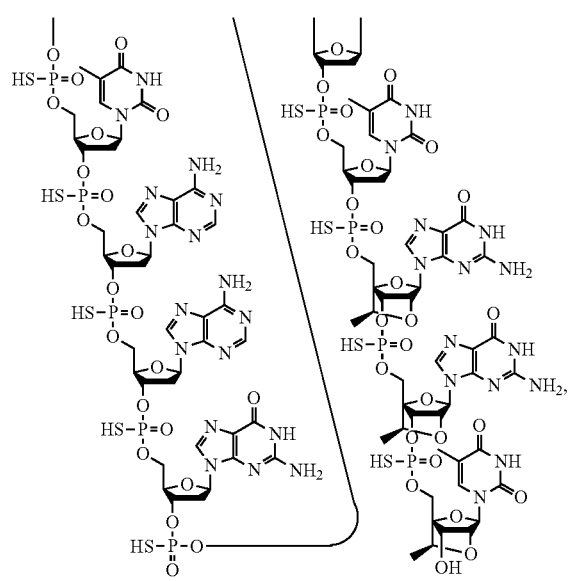
or a salt thereof. In certain embodiments, the compound is a sodium salt. In certain embodiments, the compound is a potassium salt.

In certain embodiments a compound provided herein is according to the following chemical structure:
(SEQ ID NO: 355)
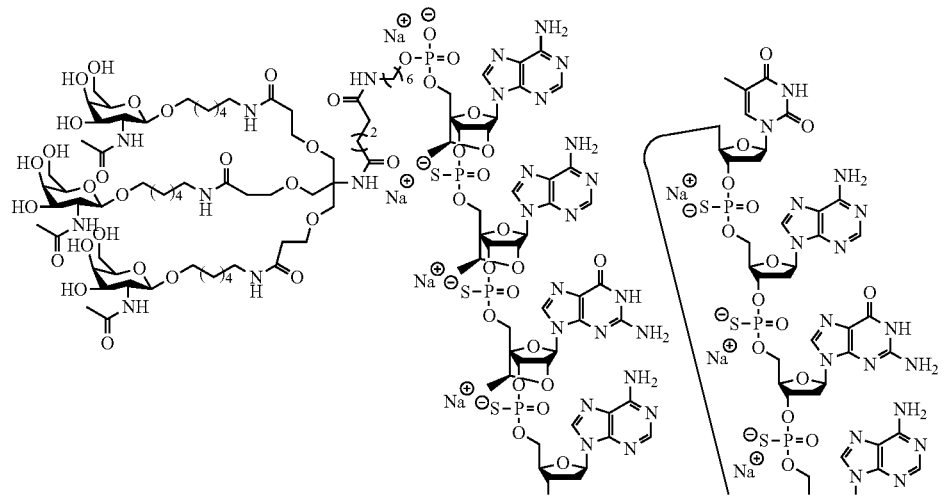
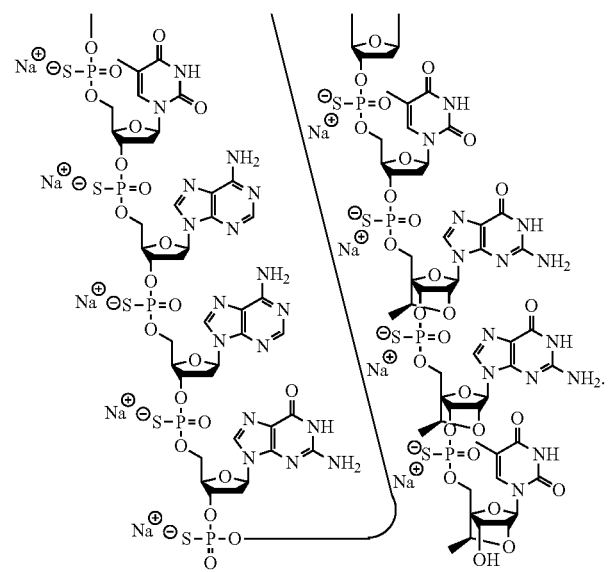

In certain embodiments, a compound provided herein is according to the following chemical structure:
(SEQ ID NO: 1602)
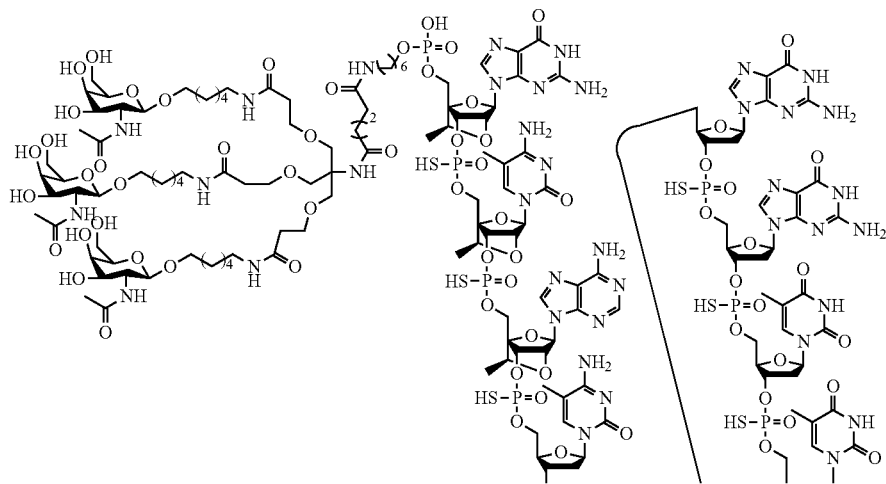
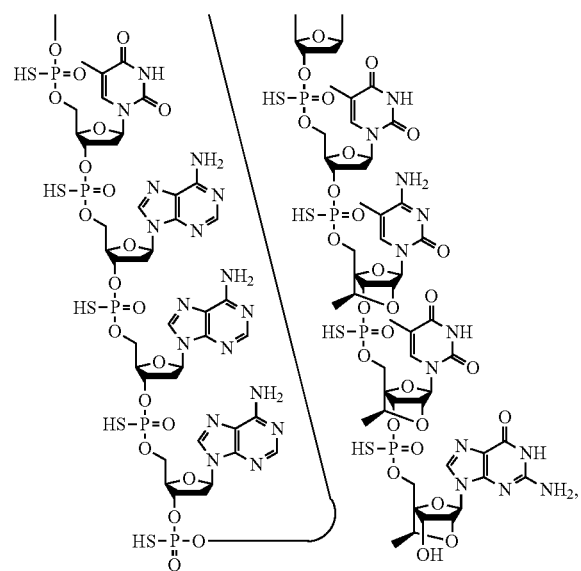
or a salt thereof. In certain embodiments, the compound is a sodium salt. In certain embodiments, the compound is a potassium salt.

In certain embodiments, a compound provided herein is according to the following chemical structure:
(SEQ ID NO: 1602)
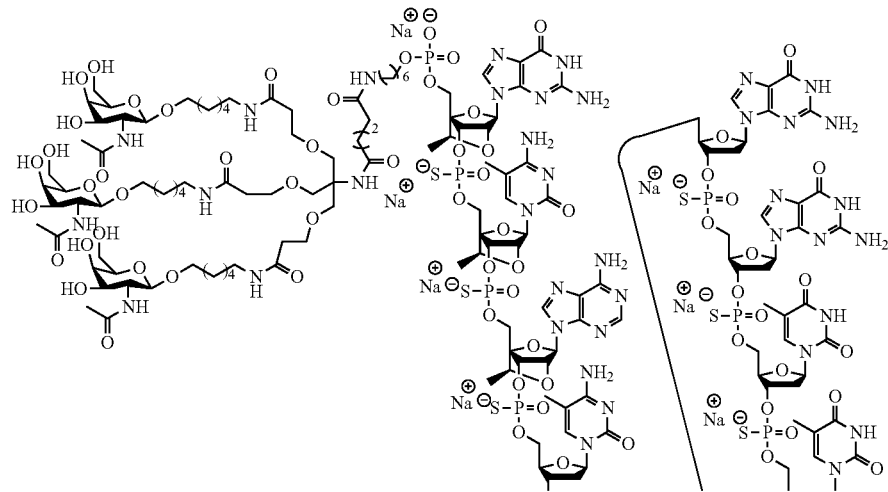
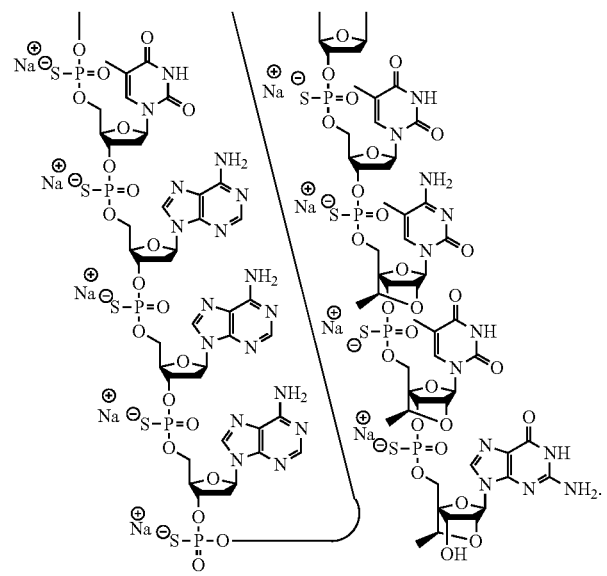

In certain embodiments, a compound provided herein k according to the following chemical structure:
(SEQ ID NO: 201)
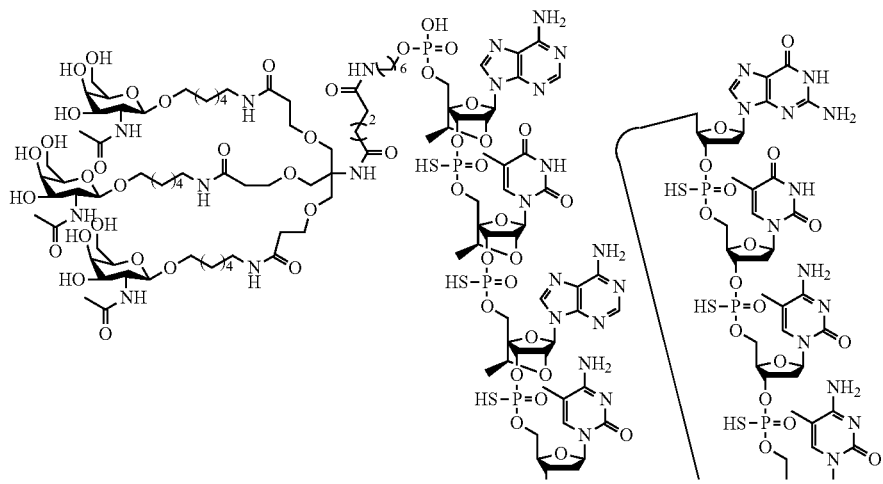
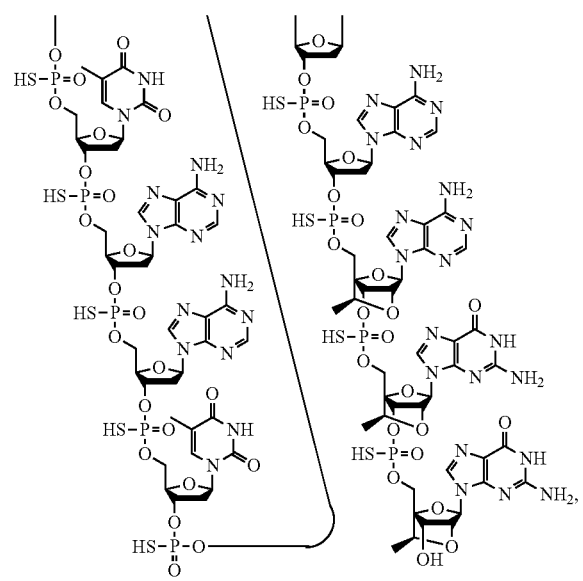
or a salt thereof. In certain embodiments, the compound is a sodium salt. In certain embodiments, the compound is a potassium salt.

In certain embodiments, a compound provided herein is according to the following chemical structure:
(SEQ ID NO: 201)
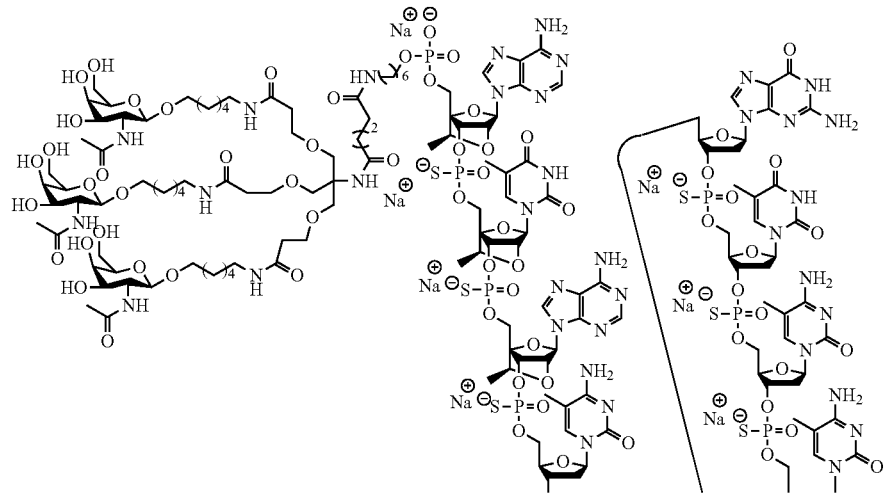
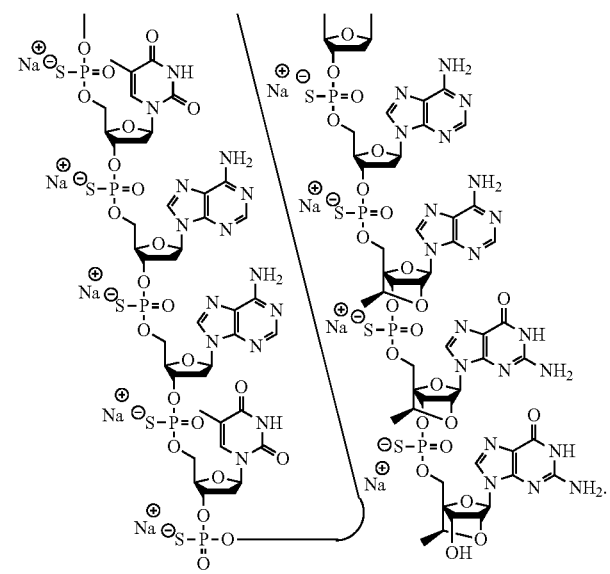

In certain embodiments, a compound provided herein is according to the following chemical structure:
(SEQ ID NO: 734)
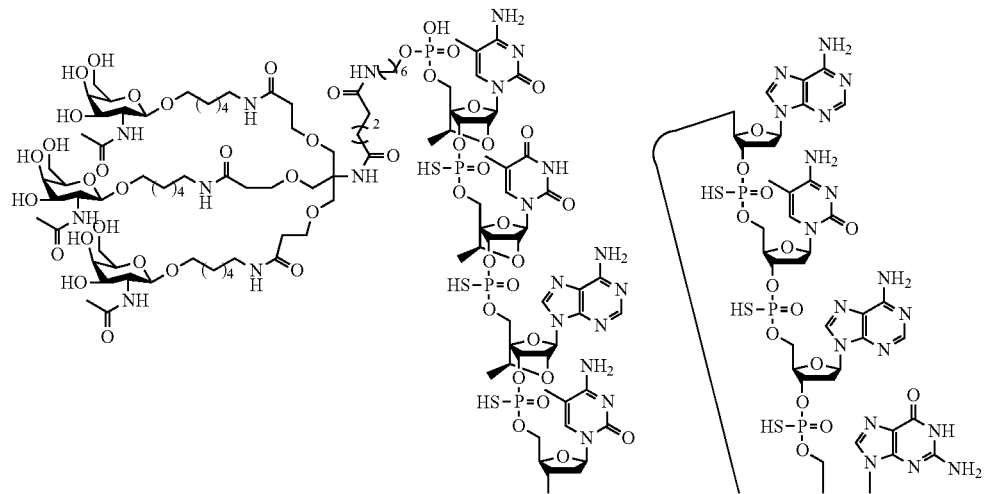
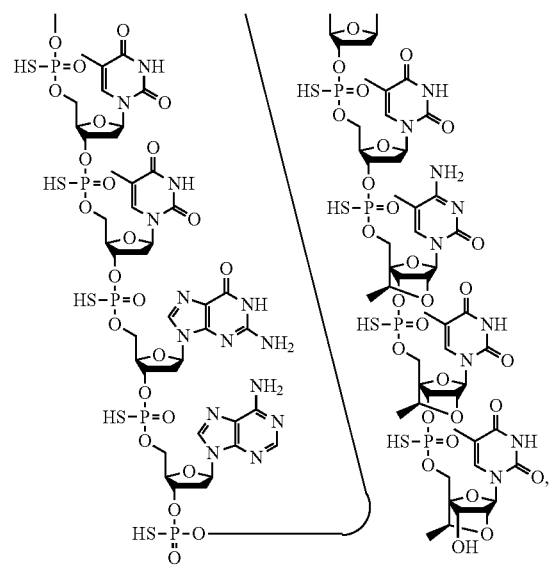
or a salt thereof. In certain embodiments, the compound is a sodium salt. In certain embodiments, the compound is a potassium salt.

In certain embodiments, a compound provided herein is according to the following chemical structure:
(SEQ ID NO: 734)
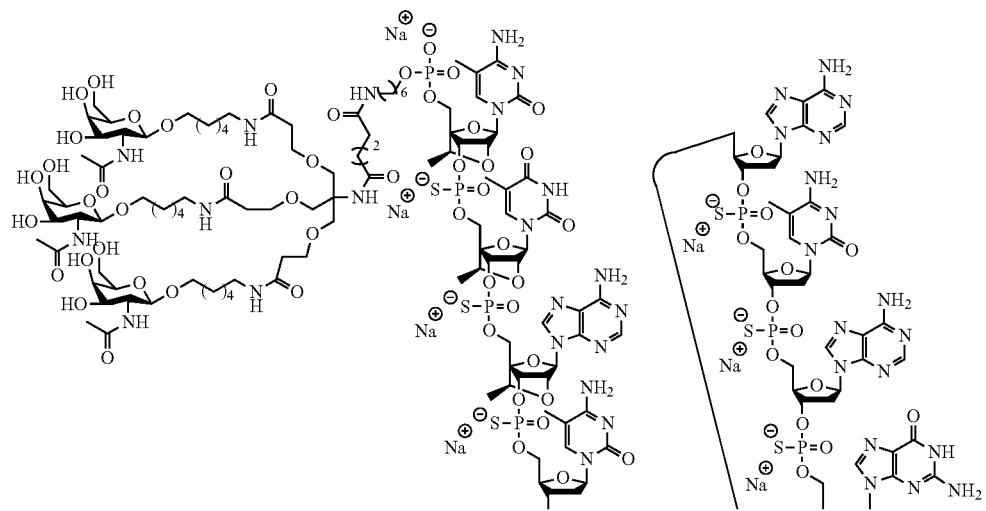
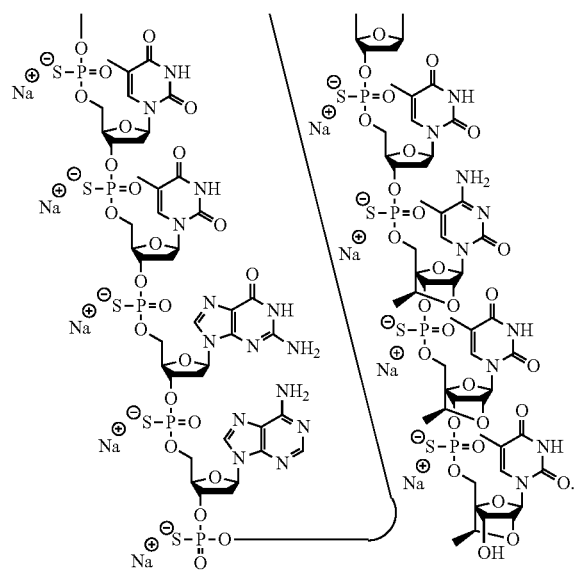

In certain embodiments, a compound provided herein is according to the following chemical structure:
(SEQ ID NO: 1249)
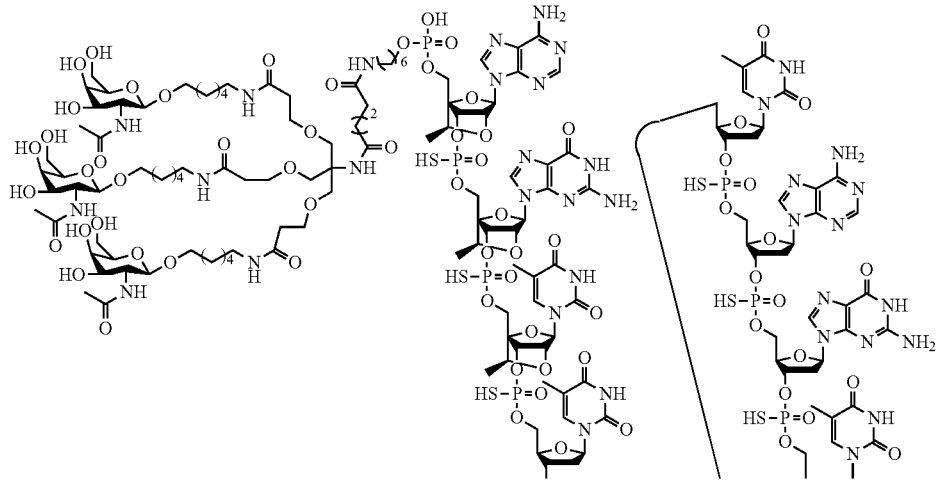
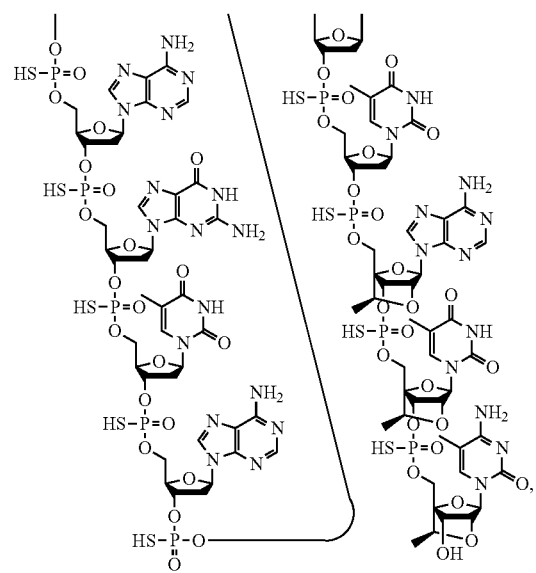
or a salt thereof. In certain embodiments, the compound is a sodium salt. In certain embodiments, the compound is a potassium salt.

In certain embodiments, a compound provided herein is according to the following chemical structure:
(SEQ ID NO: 1249)
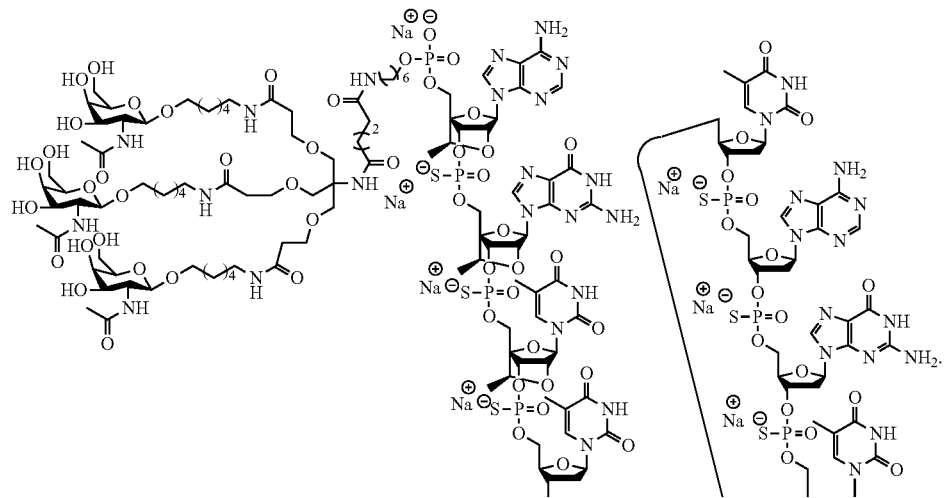
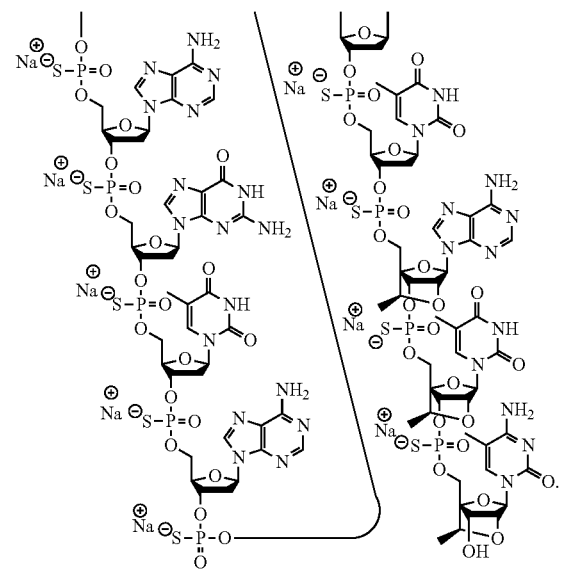

In certain embodiments, a compound provided herein is according to the following chemical structure:
(SEQ ID NO: 513)
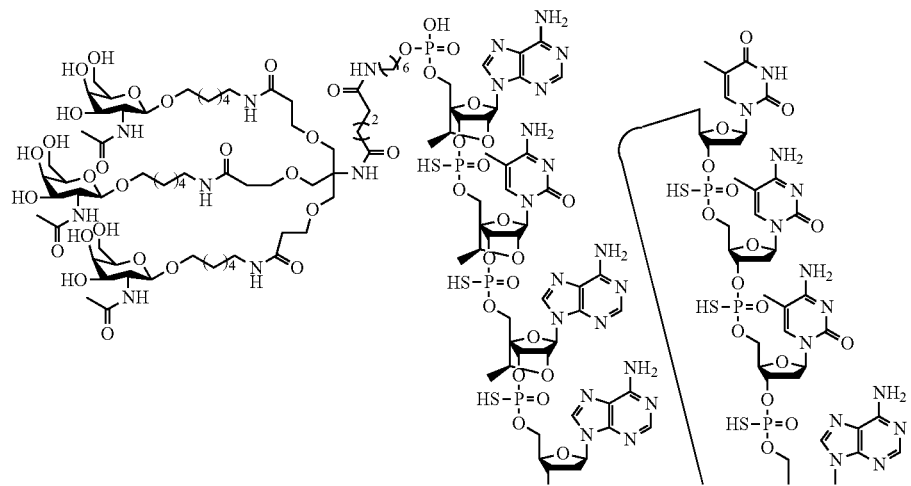
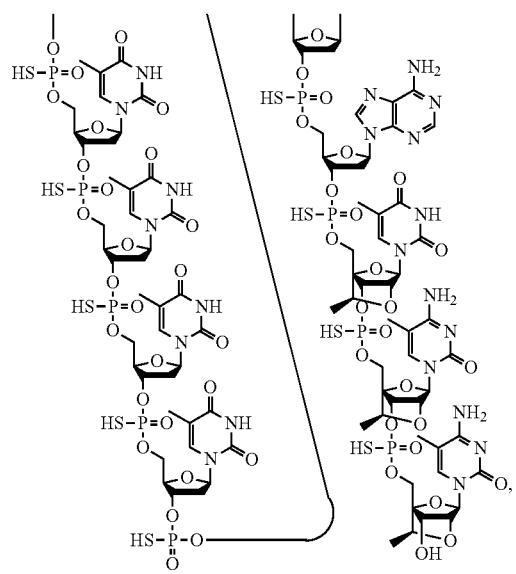
or a salt thereof. In certain embodiments, the compound is a sodium salt. In certain embodiments, the compound is a potassium salt.

In certain embodiments, a compound provided herein is according to the following chemical structure:
(SEQ ID NO: 513)
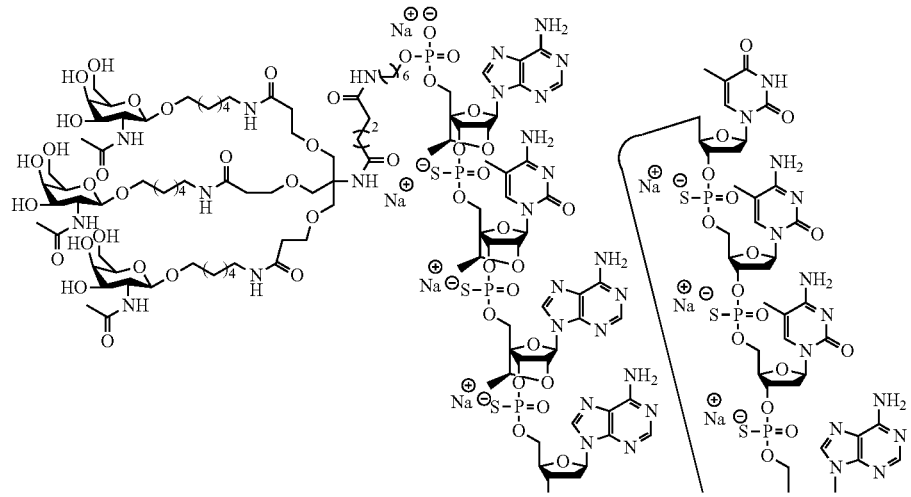
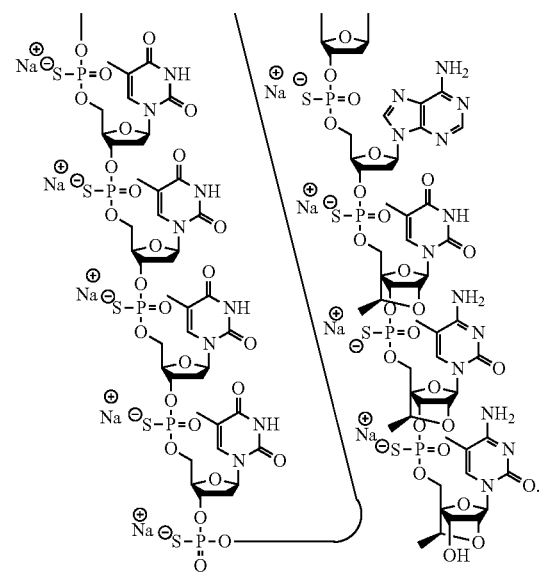

In certain embodiments, a compound provided herein is according to the following chemical structure:
(SEQ ID NO: 1449)
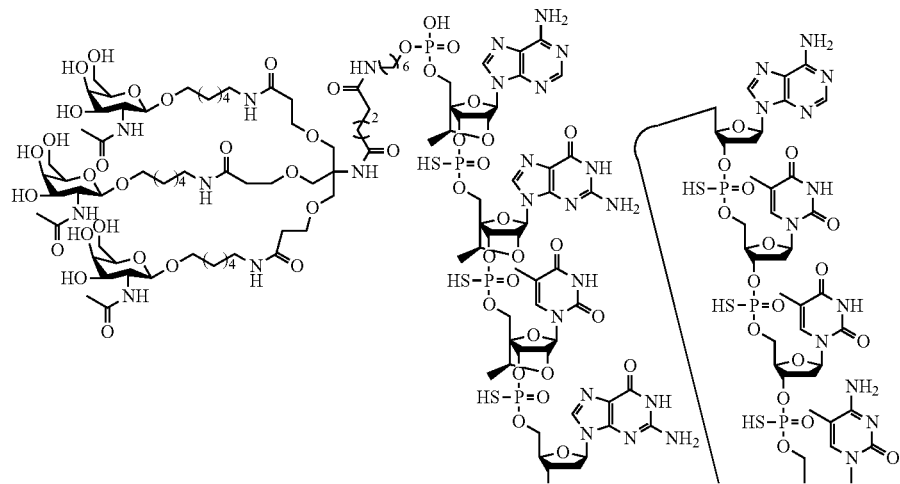
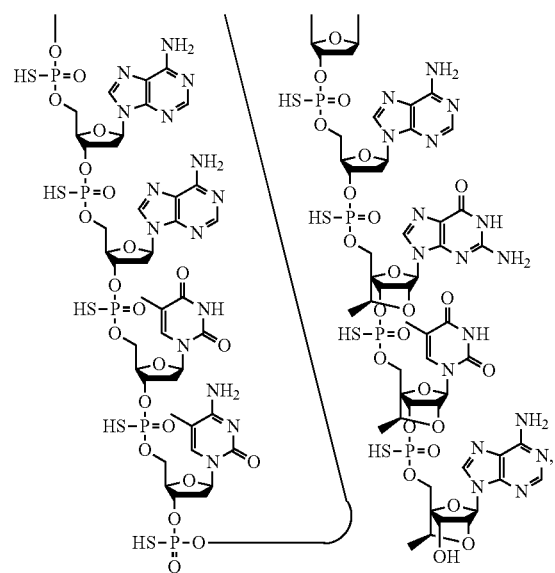
or a salt thereof. In certain embodiments, the compound is a sodium salt. In certain embodiments, the compound is a potassium salt.

In certain embodiments, a compound provided herein is according to the following chemical structure:
(SEQ ID NO: 1449)
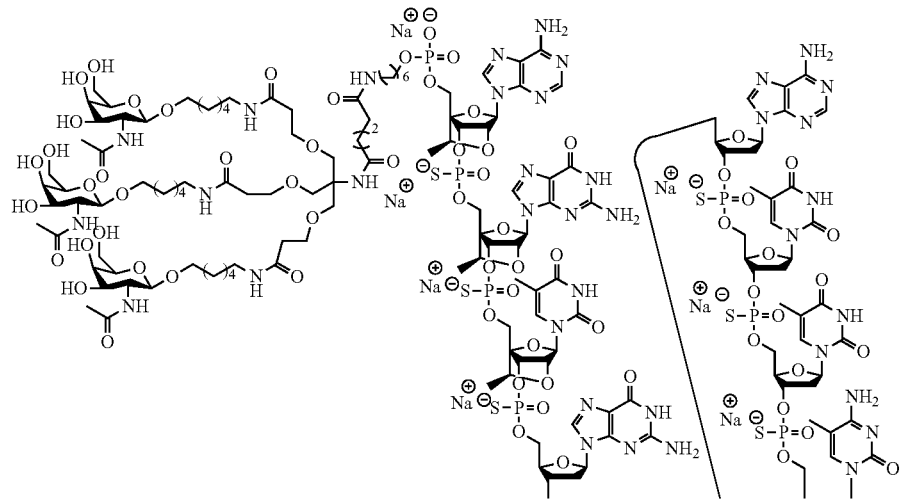
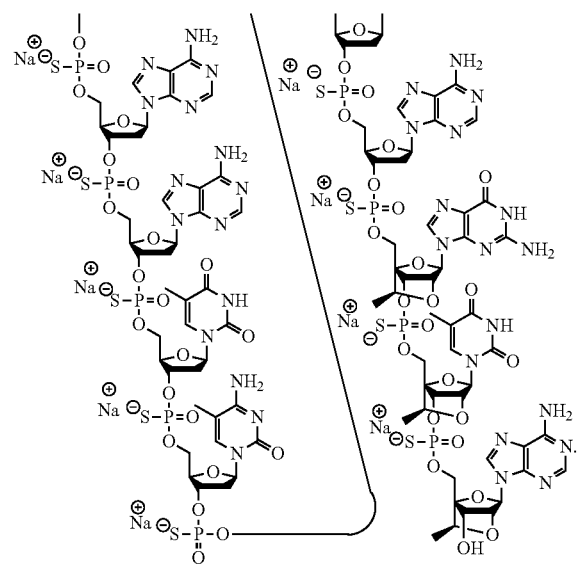

In certain embodiments, a compound provided herein is according to the following chemical structure:
(SEQ ID NO: 1448)
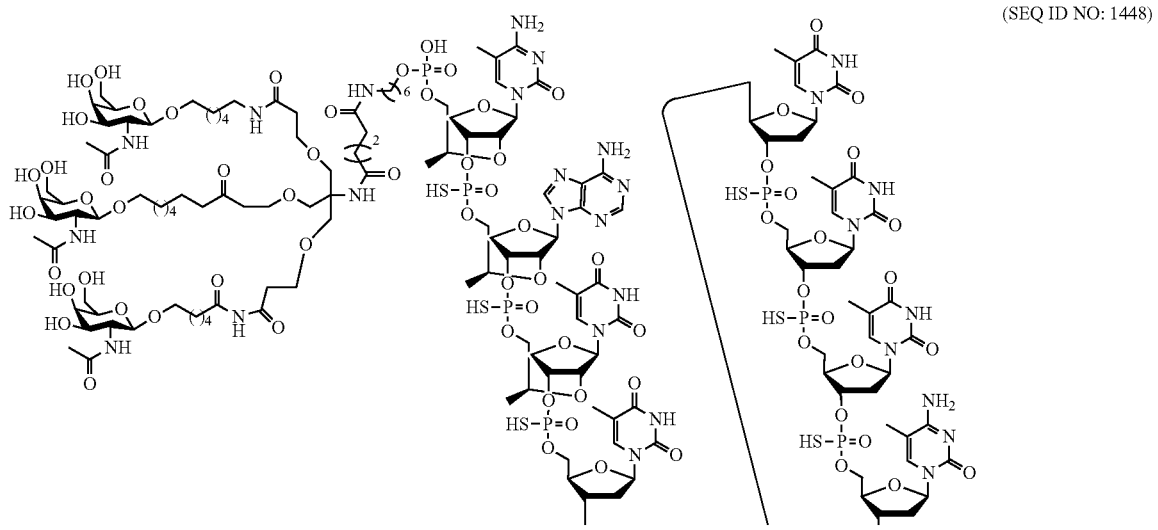
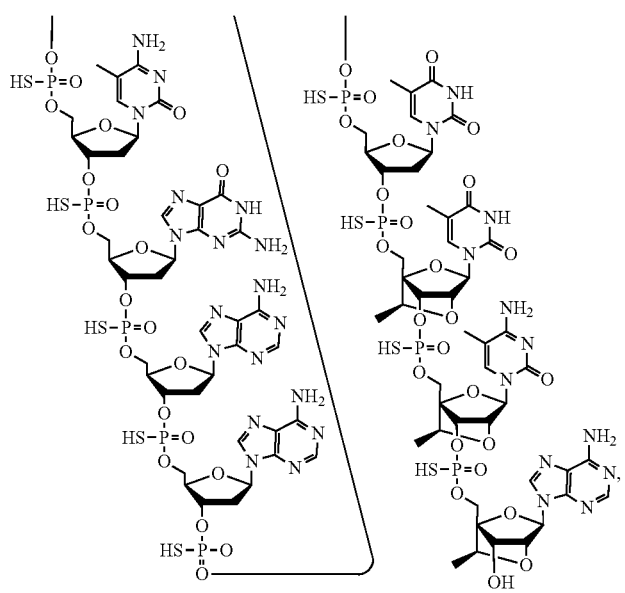
or a salt thereof. In certain embodiments, the compound is a sodium salt. In certain embodiments, the compound is a potassium salt.

In certain embodiments, a compound provided herein is according to the following chemical structure:
(SEQ ID NO: 1448)
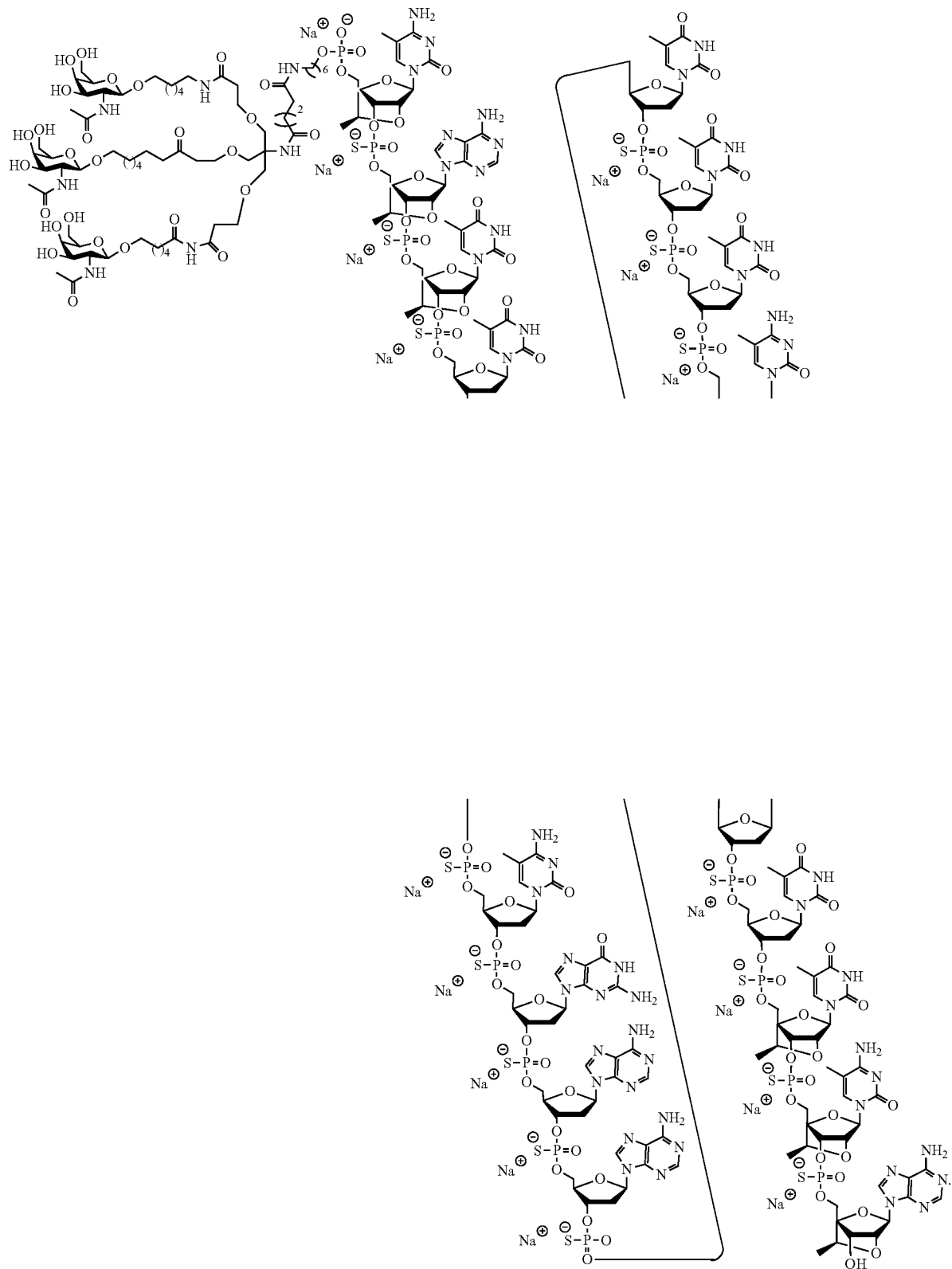

In certain embodiments, a compound provided herein is according to the following chemical structure:
(SEQ ID NO: 1595)
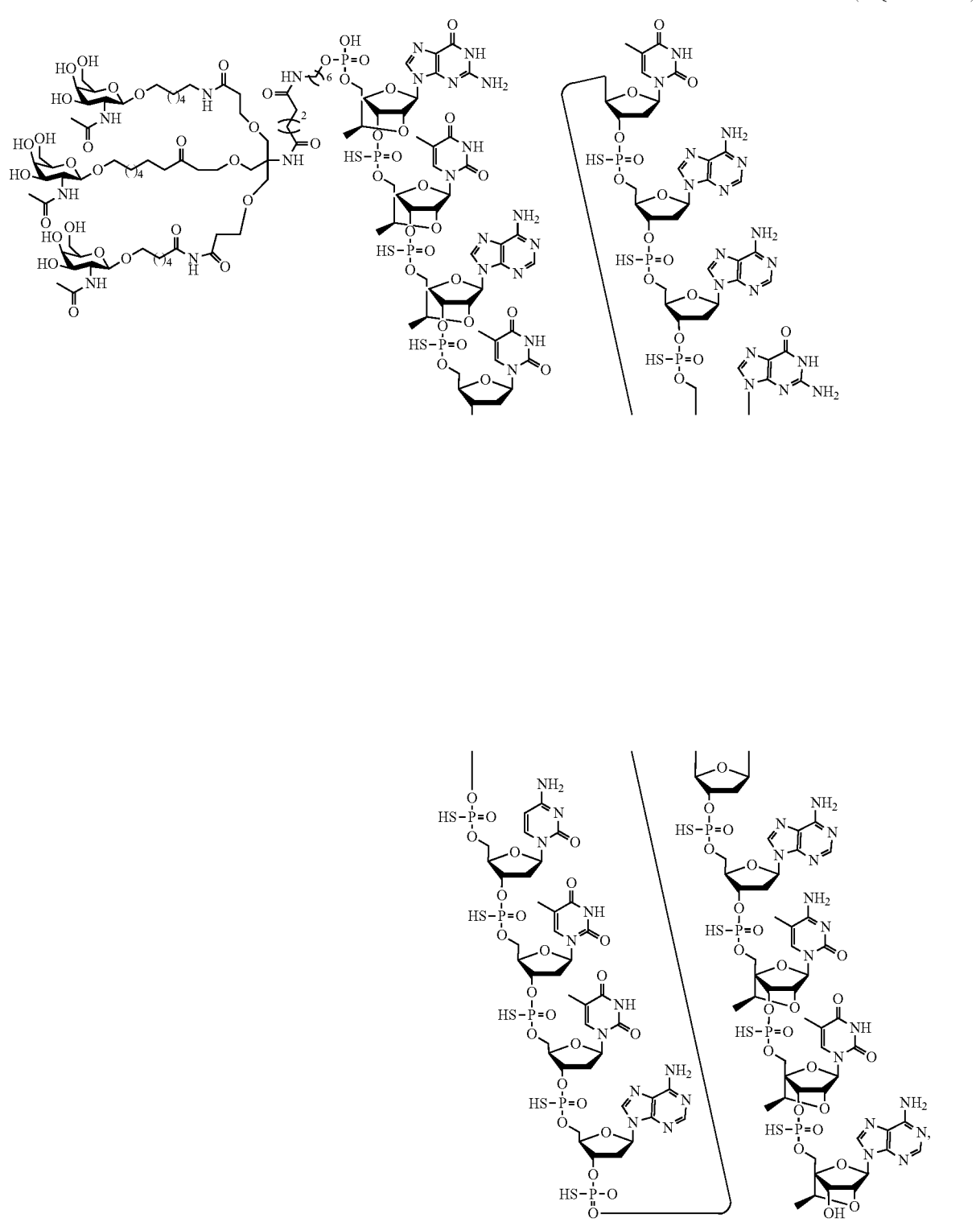
or a salt thereof. In certain embodiments, the compound is a sodium salt. In certain embodiments, the compound is a potassium salt.

In certain embodiments, a compound provided herein is according to the following chemical structure:
(SEQ ID NO: 1595)
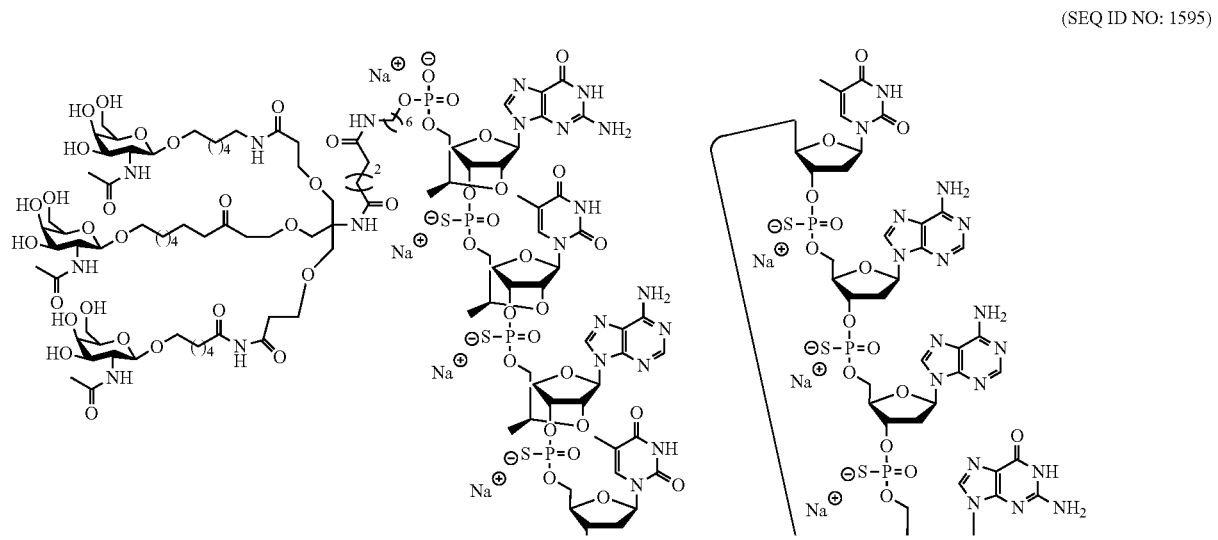
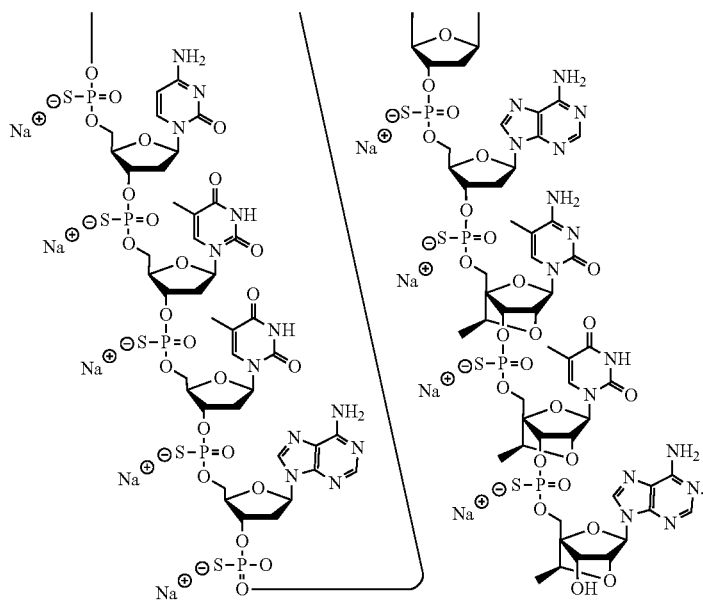

In certain embodiments, a compound provided herein is according to the following chemical structure:
(SEQ ID NO: 819)
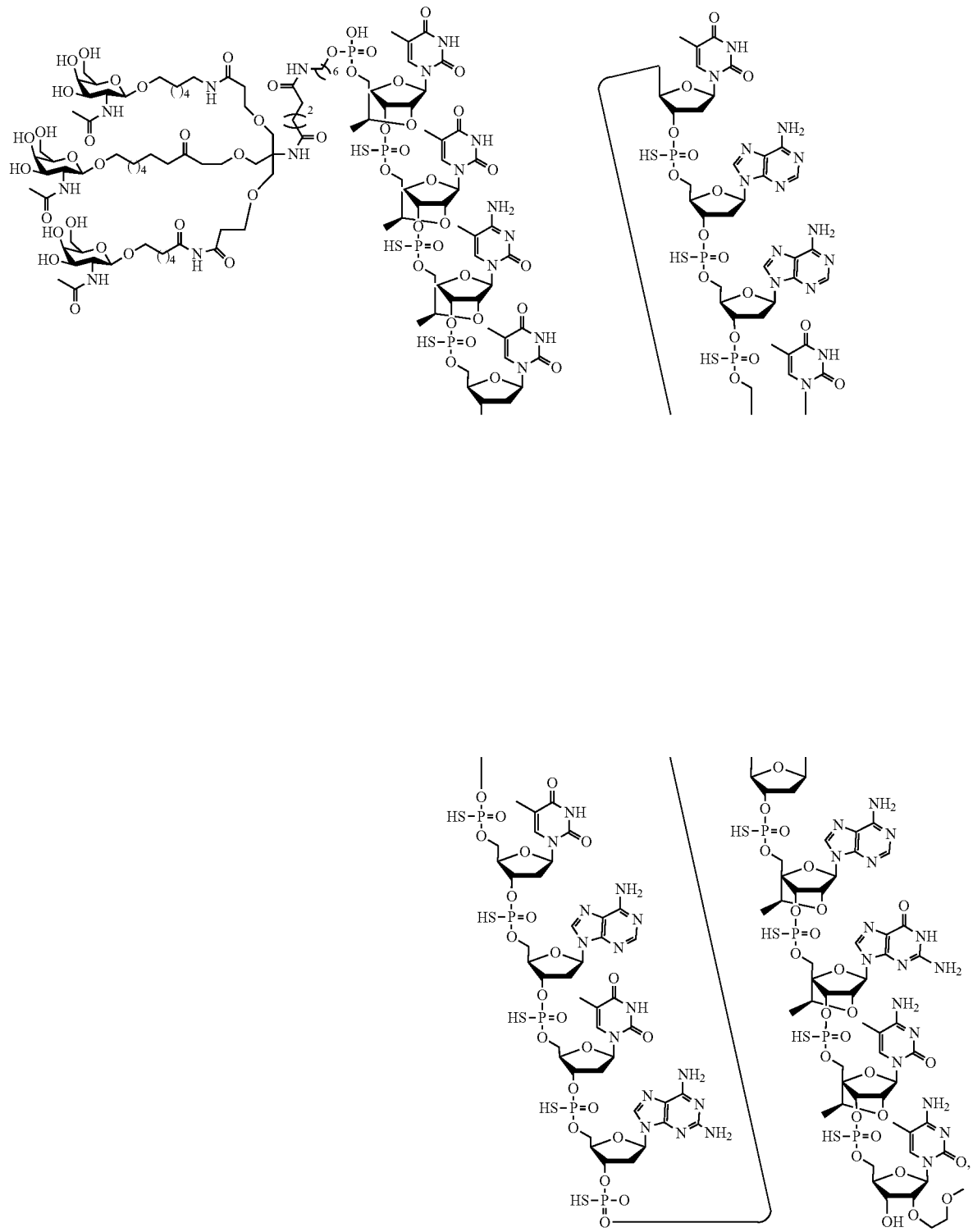
or a salt thereof. In certain embodiments, the compound is a sodium salt. In certain embodiments, the compound is a potassium salt.

In certain embodiments, a compound provided herein is according to the following chemical structure:
(SEQ ID NO: 819)
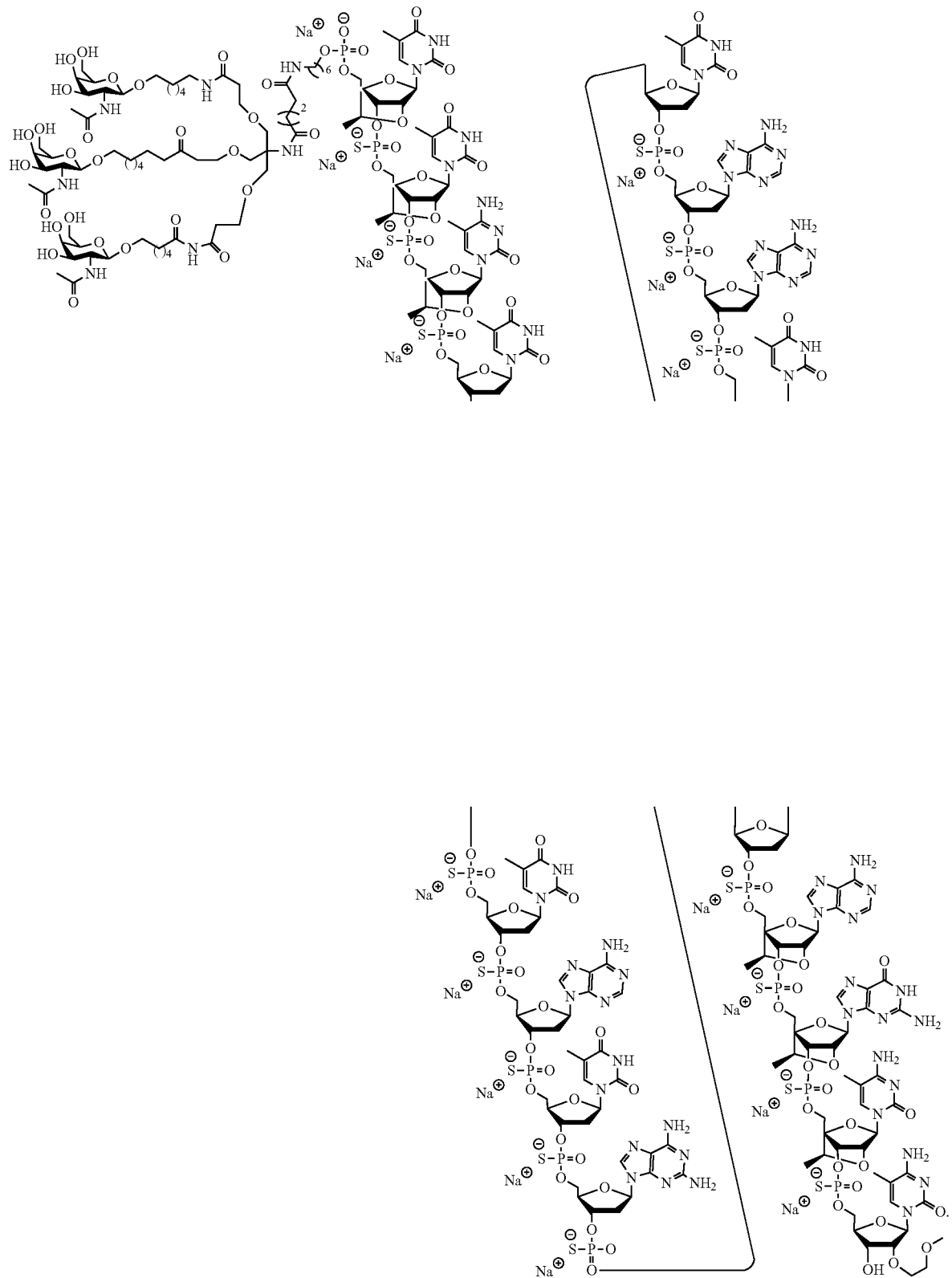

In certain embodiments, a compound provided herein is according to the following chemical structure:
(SEQ ID NO: 1595)
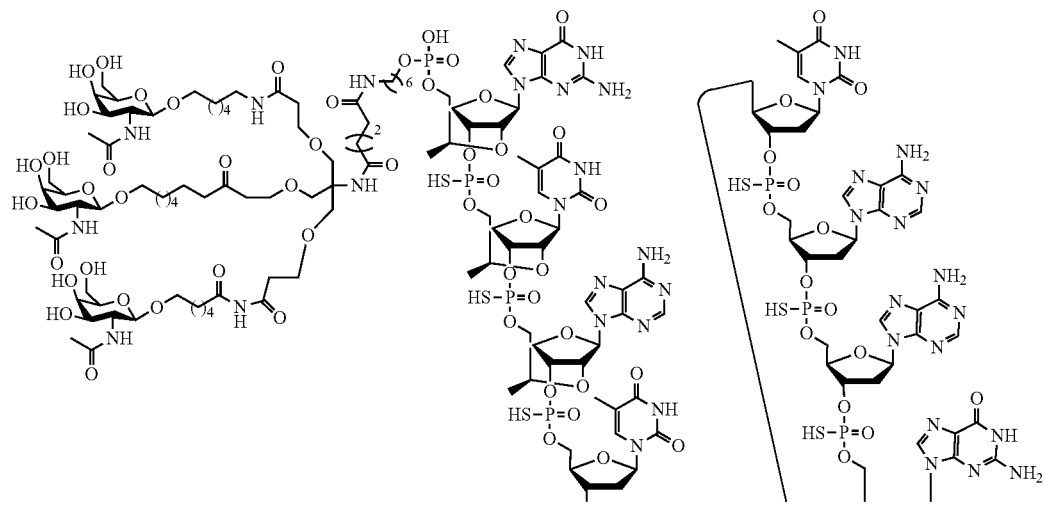
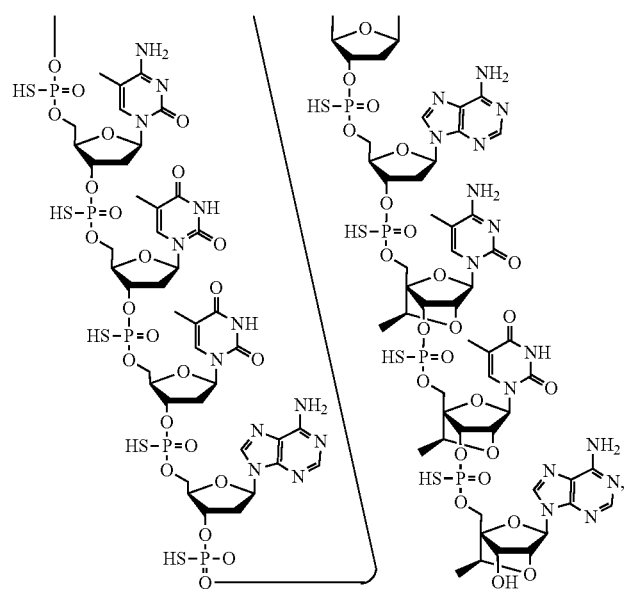
or a salt thereof. In certain embodiments, the compound is a sodium salt. In certain embodiments, the compound is a potassium salt.

In certain embodiments, a compound provided herein is according to the following chemical structure:
(SEQ ID NO: 1595)
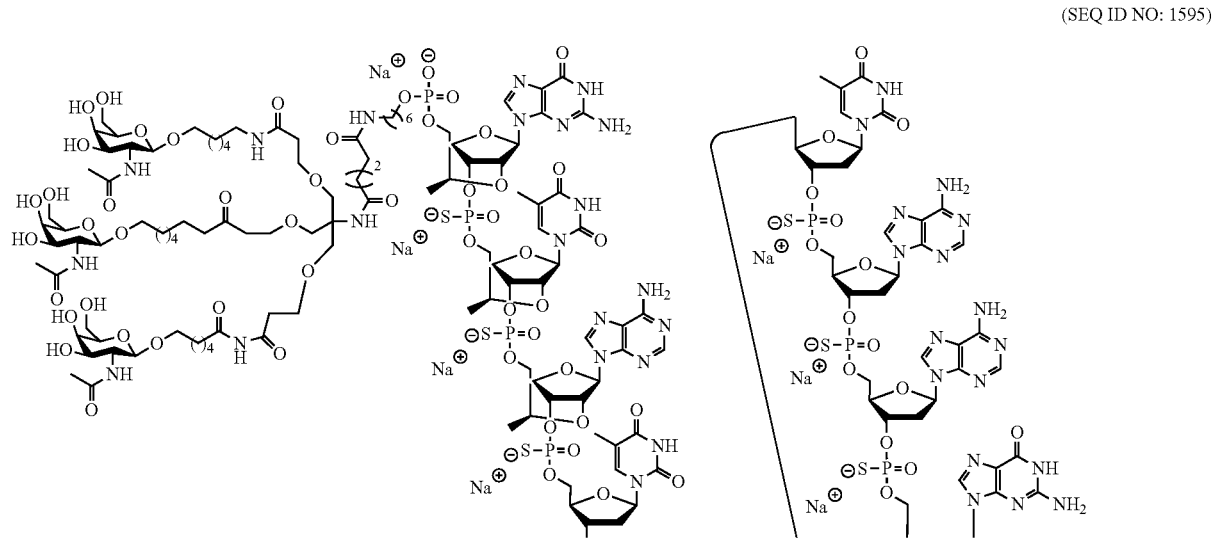
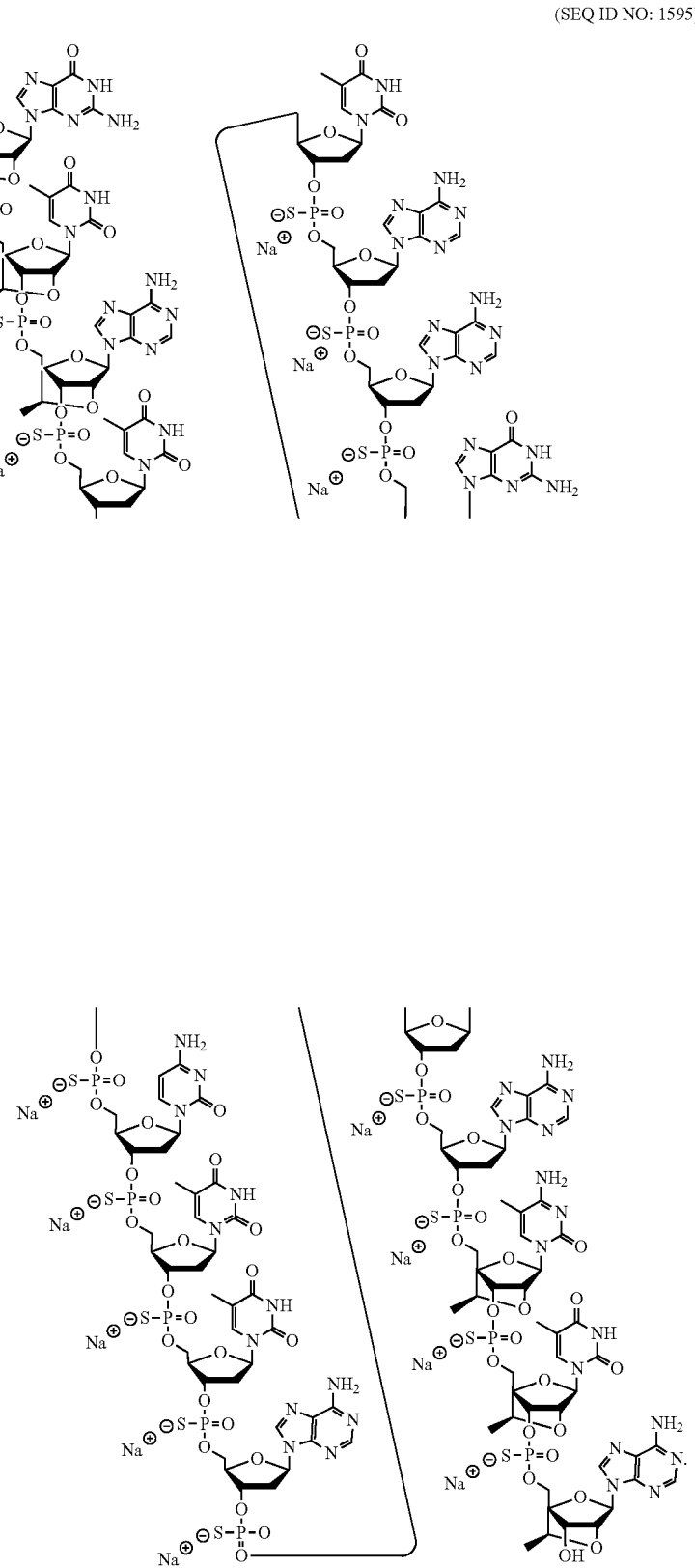

In certain embodiments, a compound provided herein is according to the following chemical structure:
(SEQ ID NO: 208)
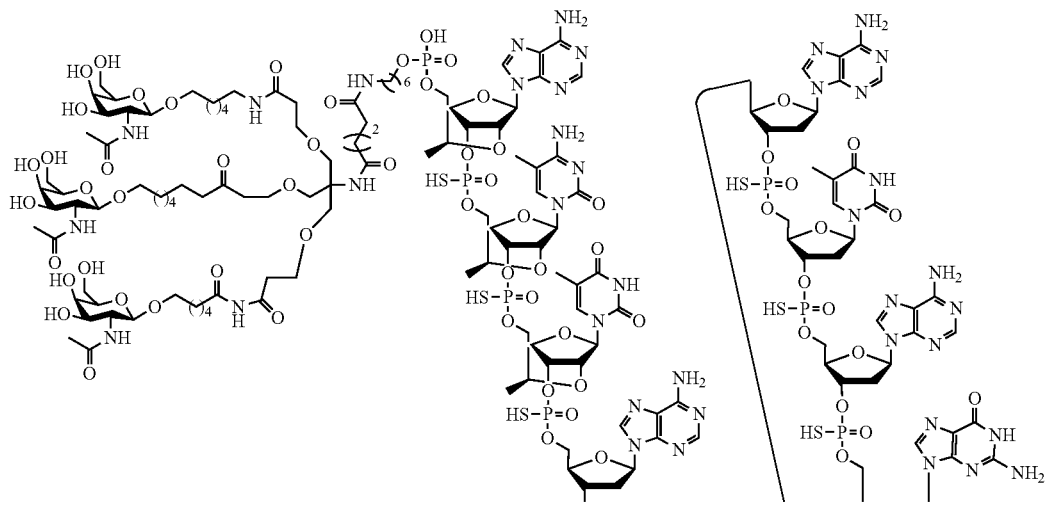
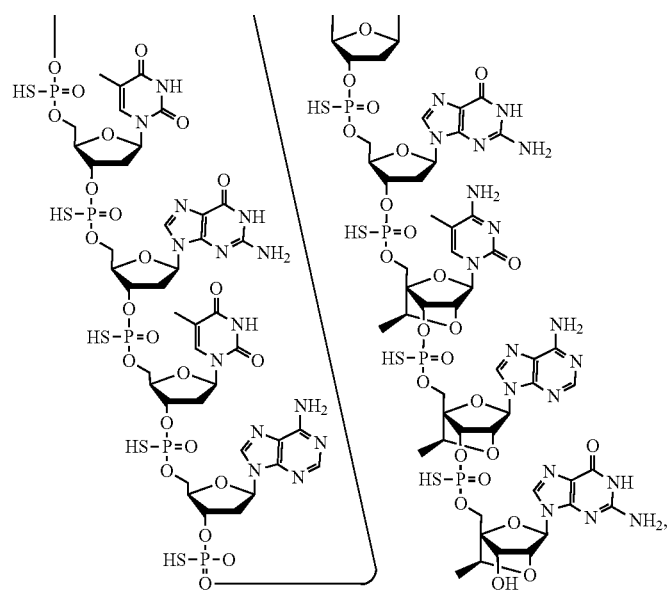
or a salt thereof. In certain embodiments, the compound is a sodium salt. In certain embodiments, the compound is a potassium salt.

In certain embodiments, a compound provided herein is according to the following chemical structure:

(SEQ ID NO: 208)

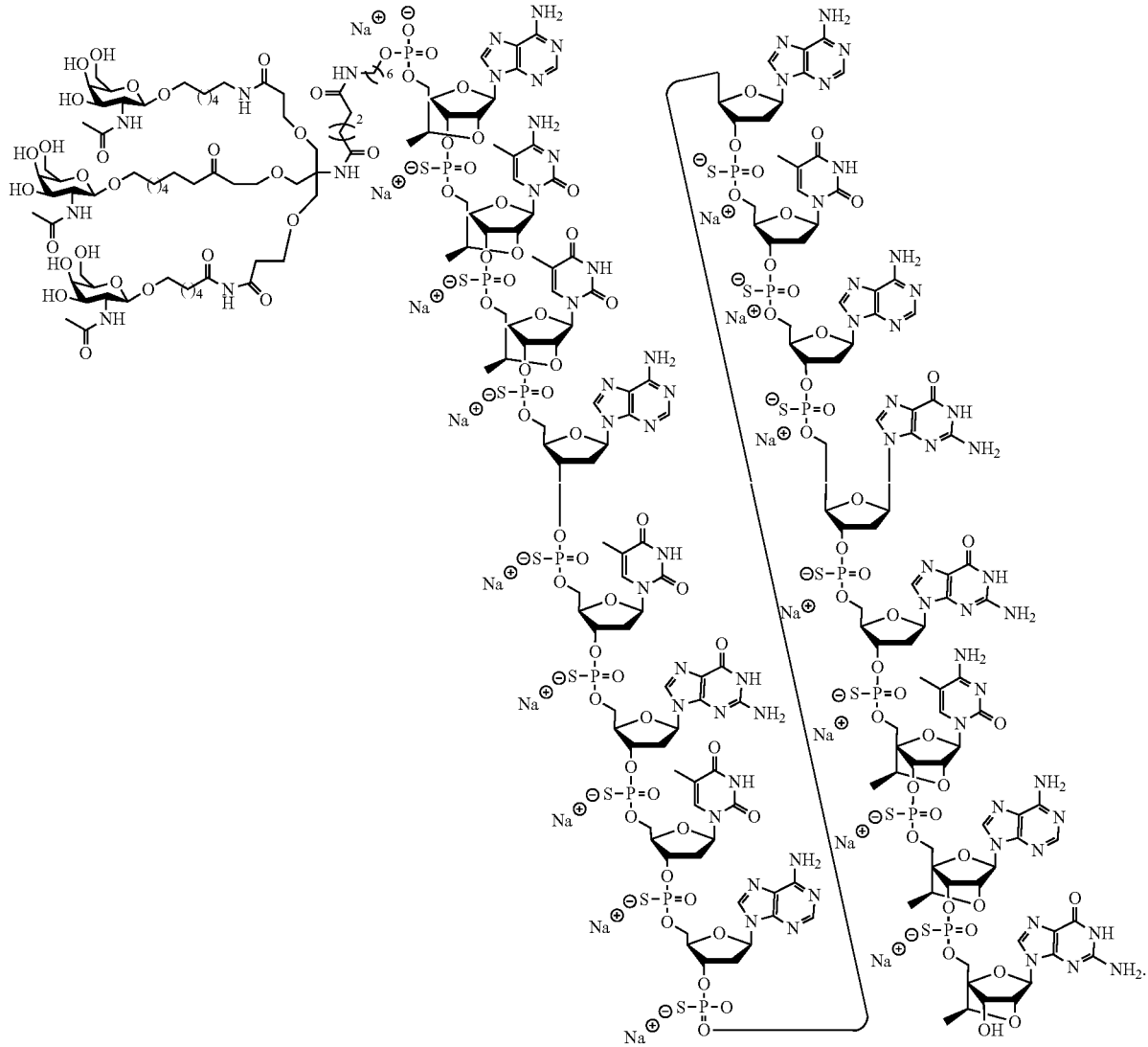

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH. In certain embodiments, the compounds or compositions as described herein are active by virtue of having at least one of an in vitro $IC_{50}$ of less than 2 µM, less than 1.5 µM, less than 1 M, less than 0.9 µM, less than 0.8 µM, less than 0.7 M, less than 0.6 µM, less than 0.5 M, less than 0.4 µM, less than 0.3 µM, less than 0.2 µM, less than 0.1 µM, less than 0.05 µM, less than 0.04 µM, less than 0.03 µM, less than 0.02 µM, or less than 0.01 µM.

In certain embodiments, the compounds or compositions as described herein are highly tolerable as demonstrated by having at least one of an increase in alanine transaminase (ALT) or aspartate transaminase (AST) value of no more than 4 fold, 3 fold, or 2 fold over control animals, or an increase in liver, spleen, or kidney weight of no more than 30%, 20%, 15%, 12%, 10%, 5%, or 2% compared to control animals. In certain embodiments, the compounds or compositions as described herein are highly tolerable as demonstrated by having no increase of ALT or AST over control animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or any pharmaceutically acceptable salt thereof and at least one of a pharmaceutically acceptable carrier or diluent. In certain embodiments, the composition has a viscosity less than about 40 centipoise (cP), less than about 30 centipose (cP), less than about 20 centipose (cP), less than about 15 centipose (cP), or less than about 10 centipose (cP). In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature, or about 20° C., about 21° C., about 22° C., about 23° C., about 24° C., about 25° C., about 26° C., about 27° C., about 28° C., about 29° C., or about 30° C.

Non-Limiting Numbered Embodiments Include:

Embodiment 1: Certain embodiments provide a compound comprising a modified oligonucleotide consisting of 8 to 80 linked nucleosides and having a nucleobase sequence comprising at least 8, at least 9, at least 10, at least 11, or at least 12 contiguous nucleobases of any of the nucleobase sequences of SEQ ID NOs: 8-2896. Certain embodiments provide a compound comprising a modified oligonucleotide consisting of 12 to 30 linked nucleosides, wherein the modified oligonucleotide has a nucleobase sequence comprising at least 8, at least 9, at least 10, at least 11, or at least 12 contiguous nucleobases of any of the nucleobase sequences of SEQ ID NOs: 8-2896.

Embodiment 2: Certain embodiments provide a compound comprising modified oligonucleotide consisting of 8 to 80 linked nucleosides and having a nucleobase sequence comprising the nucleobase sequence of any one of SEQ ID NOs: 8-2896. Certain embodiments provide a compound comprising modified oligonucleotide consisting of 12 to 30 linked nucleosides and having a nucleobase sequence comprising the nucleobase sequence of any one of SEQ ID NOs: 8-2896.

Embodiment 3: Certain embodiments provide a compound comprising a modified oligonucleotide having a nucleobase sequence consisting of any one of SEQ ID NOs: 8-2896.

Embodiment 4: Certain embodiments provide a compound comprising modified oligonucleotide consisting of 8 to 80 linked nucleosides, or consisting of 12 to 30 linked nucleosides, wherein the modified oligonucleotide has a nucleobase sequence comprising a portion of at least 8 contiguous nucleobases complementary to an equal length portion of nucleobases 3095-3454, 3095-3140, 3152-3236, 3168-3183, 3248-3328, 3312-3328, 3334-3390, 3348-3390, 3401-3420, 3429-3451, 3429-3454, 3474-3719, 3474-3644, 3478-3494, 3505-3531, 3544-3559, 3568-3634, 3671-3736, 3676-3717, 3721-3799, 3741-3771, 3750-3770, 3782-3799, 3834-3849, 3834-4154, 3877-3897, 3902-3917, 3933-3967, 3933-3979, 3988-4005, 3988-4017, 4068-4091, 4103-4118, 4123-4155, 4133-4155, 4220-4240, 4220-4264, 4249-4264, 4222-4240, 4296-4311, 4360-4378, 4389-4427, 4389-4431, 4405-4449, 4476-4496, 4517-4588, 4517-4552, 4537-4552, 4572-4588, 4640-4678, 4640-4879, 4641-4667, 4862-4879, 4991-5006, 4991-5305, 5029-5098, 5046-5098, 5104-5120, 5121-5141, 5125-5141, 5156-5256, 5158-5217, 5223-5242, 5267-5319, 5268-5319, 5395-5950, 5646-5695, 5655-5858, 5712-5752, 5712-5777, 5758-5777, 5782-5797, 5782-5862, 5804-5862, 5870-5910, 5871-6005, 5870-5910, 5870-5911, 5916-6007, 5935-5950, 5974-6007, 6029-6048, 6029-6055, 6035-6164, 6084-6099, 6084-6104, 6134-6164, 6170-6248, 6170-6275, 6170-6277, 6191-6218, 6221-6243, 6246-6275, 6284-6350, 6284-6352, 6298-6372, 6357-6372, 6388-6406, 6422-6493, 6422-6497, 6426-6621, 6567-6758, 6567-6582, 6597-6653, 6626-6653, 6710-6779, 6784-6811, 6785-6800, 6795-6811, 6913-6930, 6914-6929, 6914-6930, 6915-6930, 7101-7138, 7101-7441, 7125-7145, 7426-7441, 7473-7494, 7473-7498, 7481-7498, 7526-7543, 7550-7565, 7550-7634, 7563-7699, 7643-7676, 7680-7698, 7680-7699, 7708-7723, 7751-7819, 7768-7796, 7828-7866, 7834-7969, 7938-7968, 7938-7969, 7973-7994, 8017-8032, 8039-8186, 8039-8065, 8040-8065, 8121-8156, 8125-8151, 8164-8185, 8164-8186, 8205-8297, 8205-8220, 8236-8252, 8236-8271, 8256-8294, 8279-8297, 8487-8502, 8487-8627, 8529-8579, 8587-8628, 8636-8732, 8643-8910, 8744-8762, 8786-8910, 8939-9027, 8939-8996, 9000-9027, 9057-9096, 9080-9230, 9110-9173, 9188-9240, 9256-9275, 9312-9365, 9372-9401, 9373-9394, 9410-9446, 9410-9491, 9476-9555, 9497-9555, 9588-9678, 9588-9681, 9712-9737, 9712-9742, 9751-9811, 9751-10040, 9887-9902, 9908-10017, 10025-10040, 10058-10079, 10112-10160, 10124-10160, 10138-10160, 10180-10227, 10180-10233, 10258-10279, 10292-10310, 10293-10310, 10335-10375, 10335-10538, 10380-10538, 10554-10569, 10584-10599, 10728-10745, 10831-10870, 10930-10946, 10931-10946, 10970-10993, 10971-11015, 1100-11015, 11030-11045, 11073-11094, 11074-11094, 11115-11132, 11117-11132, 11155-11171, 11210-11228, 11210-11276, 11235-11276, 11290-11323, 11308-11323, 11384-11407, 11385-11443, 11428-11443, 11468-11529, 11542-11605, 11621-11636, 11621-11638, 11621-11668, 11652-11668, 11742-11808, 11742-11811, 11853-11881, 11853-11909, 11892-11912, 11924-11940, 11925-12226, 11953-12027, 12038-12226, 12238-12270, 12337-12531, 12337-12368, 12410-12448, 12465-12531, 12598-12642, 12598-12742, 12647-12742, 12758-12832, 12761-12832, 12862-12904, 13548-13627, 13551-13654, 13638-13674, 13688-13798, 13704-13798, 13813-13932, 13949-14064, 13951-13969, 13975-14064, 14077-14107, 14089-14107, 14126-14147, 14165-14221, 14166-14221, 14243-14298, 14243-14299, 14315-14336, 14316-14336, 14362-14414, 14432-14454, 14461-14514, 14465-14514, 14541-

14815, 14541-14636, 14724-14746, 1400-14815, 14905-14951, 14916-14951, 15019-15039, 15022-15039, 15170-15185, 15200-15232, 15211-15268, 15244-15268, 15279-15295, 15279-15399, 15312-15343, 15350-15399, 15405-15460, 15492-15526, 15570-15586, 15633-15808, 15641-15657, 15643-15711, 15716-15765, 15771-15802, 16116-16144, 16116-16149, 16189-16206, 16189-16342, 16218-16240, 16254-16310, 16327-16352, 16377-16397, 16377-16400, 16407-16439, 16407-16440, 16461-16476, 16533-16548, 16755-16770, 16895-16920, 16905-16920, 16956-16984, 16956-17092, 17014-17034, 17135-17159, 17041-17062, 17077-17092, 17135-17159, 17227-17254, 17672-17795, 17675-17872, 17802-17817, 17857-17872, 17909-17945, 17909-17971, 17953-17971, 17954-17971, 17984-18061, 17985-18048, 18075-18117, 18087-18115, 18138-18160, 18176-18193, 18505-18555, 18506-18536, 18585-18600, 18658-18712, 18662-18762, 18720-18763, 18798-18864, 18871-18888, 18901-18940, 18925-18940, 18958-18983, 18958-19013, 19388-19460, 19467-19513, 19474-19505, 19531-19626, 19533-19626, 19649-19717, 19649-19726, 19731-19801, 19731-19842, 19815-19875, 19860-19951, 19887-19951, 19970-19985, 19970-20054, 19999-20024, 20037-20061, 20087-20102, 20109-20153, 20087-20207, 20172-20212, 20356-20438, 20248-20437, 20248-20264, 20470-20508, 20481-20507, 20571-20623, 20571-20644, 20685-20700, 20706-21032, 20706-20772, 20781-20859, 20869-20984, 20990-21033, 21065-21102, 21065-21263, 21092-21632, 21276-21500, 21517-21632, 21989-22034, 22059-22087, or 22164-22209 of SEQ ID NO: 2, and wherein the nucleobase sequence of the modified oligonucleotide is at least 85/c, at least 90/c, at least 95%, or 100% complementary to SEQ ID NO: 2.

Embodiment 5: Certain embodiments provide a compound comprising a modified oligonucleotide consisting of 8 to 80 linked nucleosides, wherein the modified oligonucleotide has a nucleobase sequence complementary within nucleobases 3095-3454, 3095-3140, 3152-3236, 3168-3183, 3248-3328, 3312-3328, 3334-3390, 3348-3390, 3401-3420, 3429-3451, 3429-3454, 3474-3719, 3474-3644, 3478-3494, 3505-3531, 3544-3559, 3568-3634, 3671-3736, 3676-3717, 3721-3799, 3741-3771, 3750-3770, 3782-3799, 3834-3849, 3834-4154, 3877-3897, 3902-3917, 3933-3967, 3933-3979, 3988-4005, 3988-4017, 4068-4091, 4103-4118, 4123-4155, 4133-4155, 4220-4240, 4220-4264, 4249-4264, 4222-4240, 4296-4311, 4360-4378, 4389-4427, 4389-4431, 4405-4449, 4476-4496, 4517-4588, 4517-4552, 4537-4552, 4572-4588, 4640-4678, 4640-4879, 4641-4667, 4862-4879, 4991-5006, 4991-5305, 5029-5098, 5046-5098, 5104-5120, 5121-5141, 5125-5141, 5156-5256, 5158-5217, 5223-5242, 5267-5319, 5268-5319, 5395-5950, 5646-5695, 5655-5858, 5712-5752, 5712-5777, 5758-5777, 5782-5797, 5782-5862, 5804-5862, 5870-5910, 5871-6005, 5870-5910, 5870-5911, 5916-6007, 5935-5950, 5974-6007, 6029-6048, 6029-6055, 6035-6164, 6084-6099, 6084-6104, 6134-6164, 6170-6248, 6170-6275, 6170-6277, 6191-6218, 6221-6243, 6246-6275, 6284-6350, 6284-6352, 6298-6372, 6357-6372, 6388-6406, 6422-6493, 6422-6497, 6426-6621, 6567-6758, 6567-6582, 6597-6653, 6626-6653, 6710-6779, 6784-6811, 6785-6800, 6795-6811, 6913-6930, 6914-6929, 6914-6930, 6915-6930, 7101-7138, 7101-7441, 7125-7145, 7426-7441, 7473-7494, 7473-7498, 7481-7498, 7526-7543, 7550-7565, 7550-7634, 7563-7699, 7643-7676, 7680-7698, 7680-7699, 7708-7723, 7751-7819, 7768-7796, 7828-7866, 7834-7969, 7938-7968, 7938-7969, 7973-7994, 8017-8032, 8039-8186, 8039-8065, 8040-8065, 8121-8156, 8125-8151, 8164-8185, 8164-8186, 8205-8297, 8205-8220, 8236-8252, 8236-8271, 8256-8294, 8279-8297, 8487-8502, 8487-8627, 8529-8579, 8587-8628, 8636-8732, 8643-8910, 8744-8762, 8786-8910, 8939-9027, 8939-8996, 9000-9027, 9057-9096, 9080-9230, 9110-9173, 9188-9240, 9256-9275, 9312-9365, 9372-9401, 9373-9394, 9410-9446, 9410-9491, 9476-9555, 9497-9555, 9588-9678, 9588-9681, 9712-9737, 9712-9742, 9751-9811, 9751-10040, 9887-9902, 9908-10017, 10025-10040, 10058-10079, 10112-10160, 10124-10160, 10138-10160, 10180-10227, 10180-10233, 10258-10279, 10292-10310, 10293-10310, 10335-10375, 10335-10538, 10380-10538, 10554-10569, 10584-10599, 10728-10745, 10831-10870, 10930-10946, 10931-10946, 10970-10993, 10971-11015, 1100-11015, 11030-11045, 11073-11094, 11074-11094, 11115-11132, 11117-11132, 11155-11171, 11210-11228, 11210-11276, 11235-11276, 11290-11323, 11308-11323, 11384-11407, 11385-11443, 11428-11443, 11468-11529, 11542-11605, 11621-11636, 11621-11638, 11621-11668, 11652-11668, 11742-11808, 11742-11811, 11853-11881, 11853-11909, 11892-11912, 11924-11940, 11925-12226, 11953-12027, 12038-12226, 12238-12270, 12337-12531, 12337-12368, 12410-12448, 12465-12531, 12598-12642, 12598-12742, 12647-12742, 12758-12832, 12761-12832, 12862-12904, 13548-13627, 13551-13654, 13638-13674, 13688-13798, 13704-13798, 13813-13932, 13949-14064, 13951-13969, 13975-14064, 14077-14107, 14089-14107, 14126-14147, 14165-14221, 14166-14221, 14243-14298, 14243-14299, 14315-14336, 14316-14336, 14362-14414, 14432-14454, 14461-14514, 14465-14514, 14541-14815, 14541-14636, 14724-14746, 1400-14815, 14905-14951, 14916-14951, 15019-15039, 15022-15039, 15170-15185, 15200-15232, 15211-15268, 15244-15268, 15279-15295, 15279-15399, 15312-15343, 15350-15399, 15405-15460, 15492-15526, 15570-15586, 15633-15808, 15641-15657, 15643-15711, 15716-15765, 15771-15802, 16116-16144, 16116-16149, 16189-16206, 16189-16342, 16218-16240, 16254-16310, 16327-16352, 16377-16397, 16377-16400, 16407-16439, 16407-16440, 16461-16476, 16533-16548, 16755-16770, 16895-16920, 16905-16920, 16956-16984, 16956-17092, 17014-17034, 17135-17159, 17041-17062, 17077-17092, 17135-17159, 17227-17254, 17672-17795, 17675-17872, 17802-17817, 17857-17872, 17909-17945, 17909-17971, 17953-17971, 17954-17971, 17984-18061, 17985-18048, 18075-18117, 18087-18115, 18138-18160, 18176-18193, 18505-18555, 18506-18536, 18585-18600, 18658-18712, 18662-18762, 18720-18763, 18798-18864, 18871-18888, 18901-18940, 18925-18940, 18958-18983, 18958-19013, 19388-19460, 19467-19513, 19474-19505, 19531-19626, 19533-19626, 19649-19717, 19649-19726, 19731-19801, 19731-19842, 19815-19875, 19860-19951, 19887-19951, 19970-19985, 19970-20054, 19999-20024, 20037-20061, 20087-20102, 20109-20153, 20087-20207, 20172-20212, 20356-20438, 20248-20437, 20248-20264, 20470-20508, 20481-20507, 20571-20623, 20571-20644, 20685-20700, 20706-21032, 20706-20772, 20781-20859, 20869-20984, 20990-21033, 21065-21102, 21065-21263, 21092-21632, 21276-21500, 21517-21632, 21989-22034, 22059-22087, or 22164-22209 of SEQ ID NO: 2, and wherein said modified oligonucleotide is at least 85%, at least 90%, at least 95%, or 100% complementary to SEQ ID NO: 2.

Embodiment 6: Certain embodiments provide a compound comprising a modified oligonucleotide consisting of 8 to 80 linked nucleosides, wherein the modified oligonucleotide has a nucleobase sequence comprising a portion of at least 8 contiguous nucleobases 100% complementary to an equal length portion of nucleobases 1-46, 58-142, 1-142, 74-89, 154-197, 154-234, 200-232, 218-234, 240-345, 254-269, 354-746, 354-830, 519-534, 565-580, 603-628, 693-716, 734-750, 734-830, 749-828, 835-862, 835-957, 966-1044, 1017-1043, 1054-1106, 1055-1070, 1075-1169, 1074-1132, 1136-1169, 1175-1218, 1180-1217, 1250-1292, 1251-1279, 1296-1146, 1296-1448, 1308-1448, 1461-1481, 1461-1519, 1461-1647, 1461-1646, 1483-1535, 1538-1646, 1544-1561, 1597-1645, 1654-1685, 1654-1817, 1702-1817, 1705-1741, 1748-2211, 2174-2219, 2240-2272, 2244-2272, 2349-2370, 2350-2371, or 2378-2394 of SEQ ID NO: 1, and wherein the nucleobase sequence of the modified oligonucleotide is at least 85%, at least 90%, at least 95%, or 100% complementary to SEQ ID NO: 1.

Embodiment 7: Certain embodiments provide a compound comprising a modified oligonucleotide consisting of 8 to 80 linked nucleosides, wherein the modified oligonucleotide has a nucleobase sequence complementary within nucleobases 1-46, 58-142, 1-142, 74-89, 154-197, 154-234, 200-232, 218-234, 240-345, 254-269, 354-746, 354-830, 519-534, 565-580, 603-628, 693-716, 734-750, 734-830, 749-828, 835-862, 835-957, 966-1044, 1017-1043, 1054-1106, 1055-1070, 1075-1169, 1074-1132, 1136-1169, 1175-1218, 1180-1217, 1250-1292, 1251-1279, 1296-1146, 1296-1448, 1308-1448, 1461-1481, 1461-1519, 1461-1647, 1461-1646, 1483-1535, 1538-1646, 1544-1561, 1597-1645, 1654-1685, 1654-1817, 1702-1817, 1705-1741, 1748-2211, 2174-2219, 2240-2272, 2244-2272, 2349-2370, 2350-2371, or 2378-2394 of SEQ ID NO: 1, and wherein said modified oligonucleotide is at least 85%, at least 90%, at least 95%, or 100% complementary to SEQ ID NO: 1.

Embodiment 8: Certain embodiments provide a compound comprising a modified oligonucleotide consisting of 12 to 30 linked nucleosides, wherein the modified oligonucleotide has a nucleobase sequence comprising a portion of at least 8, at least 9, at least 10, at least 11, at least 12, at least 13, at least 14, at least 15, at least 16 contiguous nucleobases 100% complementary to an equal length portion of nucleobases 3439-3454, 3552-3567, 3754-3769, 3963-3978, 4406-4421, 4123-4138, 4139-4154, 4991-5006, 5045-5060, 5662-5677, 6476-6491, 6478-6493, 17992-18007, 21138-21153, 21415-21430, 21442-21457, or 21597-21612 of SEQ ID NO: 2, and wherein the nucleobase sequence of the modified oligonucleotide is at least 85%, at least 90%, at least 95%, or 100% complementary to SEQ ID NO: 2.

Embodiment 9: Certain embodiments provide a compound comprising a modified oligonucleotide consisting of 12 to 30 linked nucleosides, wherein the modified oligonucleotide has a nucleobase sequence comprising any one of SEQ ID NOs: 286, 817, 983, 1215, 747, 43, 355, 1602, 201, 734, 1249, 208, 513, 1449, 1448, 1595, and 819.

Embodiment 10: Certain embodiments provide a compound comprising a modified oligonucleotide having a nucleobase sequence consisting of any one of SEQ ID NO: 286, 817, 983, 1215, 747, 43, 355, 1602, 201, 734, 1249, 208, 513, 1449, 1448, 1595, and 819.

Embodiment 11: Certain embodiments provide the compound of embodiments 1-6, wherein the oligonucleotide is at least 80%, at least 85%, at least 90%, at least 95% or 100% complementary to SEQ ID NO: 2 over the entire length of the oligonucleotide.

Embodiment 12: Certain embodiments provide the compound of any one of the preceding embodiments, wherein the modified oligonucleotide comprises at least one modification selected from at least one modified internucleoside linkage, at least one modified nucleoside comprising a modified sugar moiety, and at least one modified nucleoside comprising a modified nucleobase.

Embodiment 13: Certain embodiments provide the compound of embodiment 12, wherein the modified internucleoside linkage is a phosphorothioate internucleoside linkage.

Embodiment 14: Certain embodiments provide the compound of embodiments 12 or 13, wherein at least one nucleoside of the modified oligonucleotide is a 2'-substituted nucleoside or a bicyclic nucleoside.

Embodiment 15: Certain embodiments provide the compound of embodiment 14, wherein the bicyclic sugar moiety of the bicyclic nucleoside is selected from the group consisting of: 4'-(CH$_2$)—O-2' (LNA); 4'-(CH$_2$)$_2$—O-2' (ENA); and 4'-CH(CH$_3$)—O-2' (cEt).

Embodiment 16: Certain embodiments provide the compound of any one of embodiments 12-15, wherein the modified nucleoside is 2'-O-methoxyethyl nucleoside.

Embodiment 17: Certain embodiments provide the compound of any one of embodiments 12-16, wherein the modified nucleobase is a 5-methylcytosine.

Embodiment 18: Certain embodiments provide the compound of any one of embodiments 1-17, wherein the modified oligonucleotide has:
  a gap segment consisting of linked 2'-deoxynucleosides;
  a 5' wing segment consisting of linked nucleosides; and
  a 3' wing segment consisting of linked nucleosides;
wherein the gap segment is positioned immediately adjacent to and between the 5' wing segment and the 3' wing segment and wherein each nucleoside of each wing segment comprises a modified sugar.

Embodiment 19: Certain embodiments provide the compound of any one of embodiment 1-18, wherein the modified sugar moiety of each nucleoside of each wing segment is selected from 2'-O-Me, 2'-MOE, and cEt sugar moieties.

Embodiment 20: Certain embodiments provide the compound of any of one embodiment 1-19, wherein the modified oligonucleotide comprises:
- a gap segment consisting of ten linked deoxynucleosides;
- a 5' wing segment consisting of three linked nucleosides; and
- a 3' wing segment consisting of three linked nucleosides;

wherein the gap segment is positioned between the 5' wing segment and the 3' wing segment, wherein each nucleoside of each wing segment comprises a cEt nucleoside; wherein each internucleoside linkage is a phosphorothioate linkage and wherein each cytosine is a 5-methylcytosine.

Embodiment 21: Certain embodiments provide the compound of any of one embodiment 1-20, wherein the modified oligonucleotide comprises:
- a gap segment consisting of ten linked deoxynucleosides;
- a 5' wing segment consisting of three linked nucleosides; and
- a 3' wing segment consisting of three linked nucleosides;

wherein the gap segment is positioned between the 5' wing segment and the 3' wing segment, wherein each nucleoside of each wing segment comprises a cEt nucleoside; wherein at least one internucleoside linkage is a phosphorothioate linkage and wherein each cytosine is a 5-methylcytosine.

Embodiment 22: Certain embodiments provide the compound of any of the preceding embodiments, wherein the modified oligonucleotide comprises:
- a gap segment consisting of nine linked 2'-deoxynucleosides;
- a 5' wing segment consisting of three linked nucleosides; and
- a 3' wing segment consisting of four linked nucleosides;

wherein the gap segment is positioned between the 5' wing segment and the 3' wing segment, wherein each nucleoside of the 5' wing segment comprises a cEt nucleoside; wherein the sugar moieties of the nucleosides of the 3' wing segment are 5'-cEt-cEt-cEt-MOE-3'; wherein each internucleoside linkage is a phosphorothioate linkage and wherein each cytosine is a 5-methylcytosine.

Embodiment 23: Certain embodiments provide the compound of any of the preceding embodiments, wherein the modified oligonucleotide comprises:
- a gap segment consisting of nine linked 2'-deoxynucleosides;
- a 5' wing segment consisting of three linked nucleosides; and
- a 3' wing segment consisting of four linked nucleosides;

wherein the gap segment is positioned between the 5' wing segment and the 3' wing segment, wherein each nucleoside of the 5' wing segment comprises a cEt nucleoside; wherein each sugar moiety of the nucleosides of the 3' wing segment are selected from cEt and 2'-MOE sugar moieties; wherein each internucleoside linkage is a phosphorothioate linkage and wherein each cytosine is a 5-methylcytosine.

Embodiment 24: Certain embodiments provide the compound of any one of the preceding embodiments, wherein the modified oligonucleotide comprises:
- a gap segment consisting of ten linked nucleosides;
- a 5' wing segment consisting of three linked nucleosides; and
- a 3' wing segment consisting of four linked nucleosides;

wherein the gap segment is positioned between the 5' wing segment and the 3' wing segment and wherein the gap segment consists of 5'-one deoxy, one 2'-O-methyl nucleoside, and eight deoxynucleosides-3', wherein each nucleoside of each of the wing segments comprises a cEt nucleoside; wherein each internucleoside linkage is a phosphorothioate linkage and wherein each cytosine is a 5-methylcytosine.

Embodiment 25: Embodiment 24: Certain embodiments provide the compound of any one of the preceding embodiments, wherein the modified oligonucleotide comprises:
- a gap segment consisting of ten linked nucleosides;
- a 5' wing segment consisting of three linked nucleosides; and
- a 3' wing segment consisting of four linked nucleosides;

wherein the gap segment is positioned between the 5' wing segment and the 3' wing segment and wherein the nucleosides of the gap segment are selected from deoxynucleosides, cEt nucleosides and 2'-MOE nucleosides, wherein each nucleoside of each of the wing segments comprises a cEt nucleoside; wherein each internucleoside linkage is a phosphorothioate linkage and wherein each cytosine is a 5-methylcytosine.

Embodiment 26: Certain embodiments provide the compound of any one of embodiments 1-25, wherein the compound is single-stranded.

Embodiment 27: Certain embodiments provide the compound of any one of embodiments 1-25, wherein the modified oligonucleotide is hybridized to a second oligonucleotide to form a double-stranded antisense compound.

Embodiment 28: Certain embodiments provide the compound of any one of embodiments 1-27, wherein at least one of the nucleotides of the modified oligonucleotide is a ribonucleotide.

Embodiment 29: Certain embodiments provide the compound of any one of embodiments 1-27, wherein at least one of the nucleotides of the modified oligonucleotide is a deoxyribonucleotide.

Embodiment 30: Certain embodiments provide the compound of any one of embodiments 1-23, wherein the modified oligonucleotide consists of 10 to 30 linked nucleosides.

Embodiment 31: Certain embodiments provide the compound of any one of embodiments 1-30, wherein the modified oligonucleotide consists of 10 to 30 linked nucleosides.

Embodiment 32: Certain embodiments provide the compound of any one of embodiments 1-30, wherein the modified oligonucleotide consists of 16 to 30 linked nucleosides.

Embodiment 33: Certain embodiments provide a compound comprising a modified oligonucleotide consisting of 16 linked nucleosides, wherein the modified oligonucleotide has a nucleobase sequence selected from any one of SEQ ID NOs: 286, 817, 983, 1215, 747, 43, 355, 1602, 201, 734, 1249, 208, 513, 1449, 1448, 1595, and 819, wherein the modified oligonucleotide comprises:
a gap segment consisting of linked deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

Embodiment 34: Certain embodiments provide a compound comprising a modified oligonucleotide consisting of 16 linked nucleosides, wherein the modified oligonucleotide has a nucleobase sequence selected from any one of SEQ ID NOs: 286, 817, 983, 1215, 747, 43, 355, 1602, 201, 734, 1249, 208, 513, 1449, 1448, and 1595, wherein the modified oligonucleotide comprises
a gap segment consisting of ten linked deoxynucleosides;
a 5' wing segment consisting of three linked nucleosides; and
a 3' wing segment consisting of three linked nucleosides;
wherein the gap segment is positioned between the 5' wing segment and the 3' wing segment; wherein the 5' wing segment and the 3' wing segment comprise cEt sugars; wherein each internucleoside linkage is a phosphorothioate linkage; and wherein each cytosine is a 5-methylcytosine.

Embodiment 35: Certain embodiments provide a compound comprising a modified oligonucleotide consisting of 16 linked nucleosides, wherein the modified oligonucleotide has a nucleobase sequence consisting of SEQ ID NO: 819, wherein the modified oligonucleotide comprises:
a gap segment consisting of ninc linked 2'-deoxynucleosides;
a 5' wing segment consisting of three linked nucleosides; and
a 3' wing segment consisting of four linked nucleosides;
wherein the gap segment is positioned between the 5' wing segment and the 3' wing segment, wherein each nucleoside of the 5' wing segment comprises a cEt sugar; wherein the sugar residues of the nucleosides of the 3' wing segment are 5'-cEt-cEt-cEt-MOE-3'; wherein each internucleoside linkage is a phosphorothioate linkage and wherein each cytosine is a 5-methylcytosine.

Embodiment 36: Certain embodiments provide a modified oligonucleotide consisting of 16 linked nucleosides, wherein the modified oligonucleotide has a nucleobase sequence consisting of SEQ ID NO: 1595, wherein the modified oligonucleotide comprises:
a gap segment consisting of ten linked nucleosides;
a 5' wing segment consisting of three linked nucleosides; and
a 3' wing segment consisting of four linked nucleosides;
wherein the gap segment is positioned between the 5' wing segment and the 3' wing segment and wherein the gap segment consists of 5'-one deoxy, one 2'-O-methyl nucleoside, and eight deoxynucleosides-3', wherein each nucleoside of each of the wing segments comprises a cEt sugar; wherein each internucleoside linkage is a phosphorothioate linkage and wherein each cytosine is a 5-methylcytosine.

Embodiment 37: Certain embodiments provide the compound of any preceding embodiment, comprising a conjugate group.

Embodiment 38: Certain embodiments provide the compound of embodiment 37, wherein the conjugate group comprises a GalNAc cluster comprising 1-3 GalNAc ligands.

Embodiment 39: Certain embodiments provide the compound of embodiment 37 or embodiment 38, wherein the conjugate group comprises a conjugate linker consisting of a single bond.

Embodiment 40: Certain embodiments provide the compound of any one of embodiments 37-39, wherein the conjugate group comprises a cleavable linker.

Embodiment 41: Certain embodiments provide the compound of any one of embodiments 37-40, wherein the conjugate group comprises a conjugate linker comprising 1-3 linker-nucleosides.

Embodiment 42: Certain embodiments provide the compound of any one of embodiments 37-41, wherein the conjugate group is attached to the modified oligonucleotide at the 5'-end of the modified oligonucleotide.

Embodiment 42: Certain embodiments provide the compound of any one of embodiments 37-41, wherein the conjugate group is attached to the modified oligonucleotide at the 3'-end of the modified oligonucleotide.

Embodiment 43: Certain embodiments provide the compound having the following chemical structure or salt thereof:

101
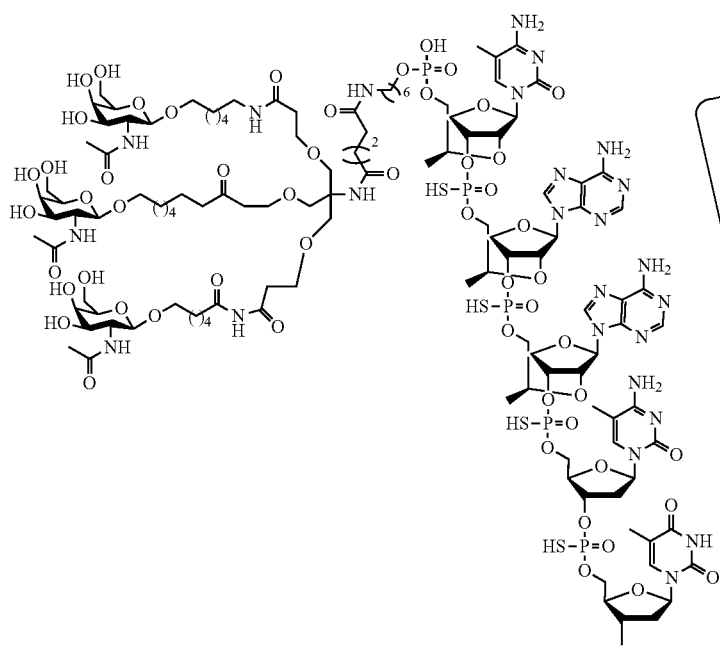
102
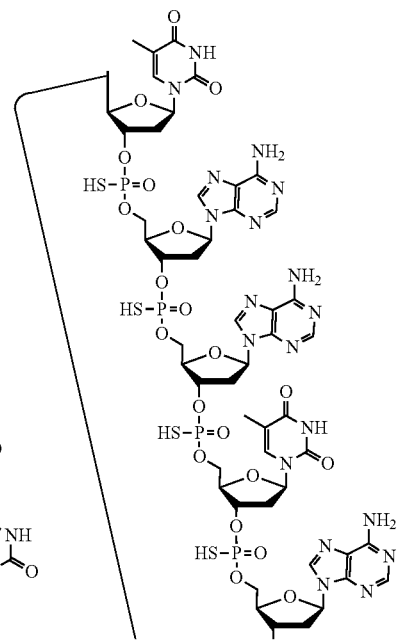
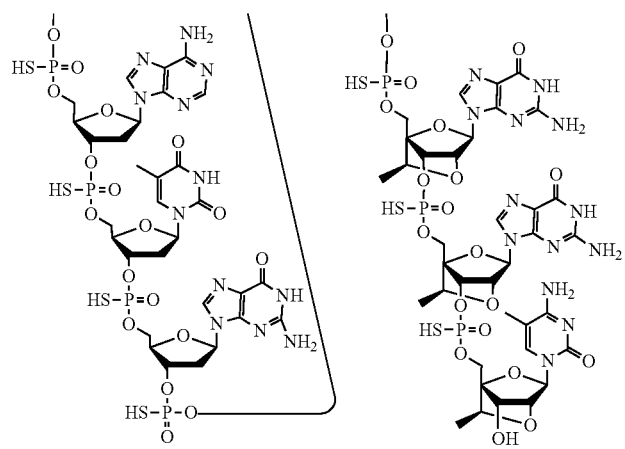
Embodiment 44: Certain embodiments provide the compound having the following chemical structure or salt thereof:

103
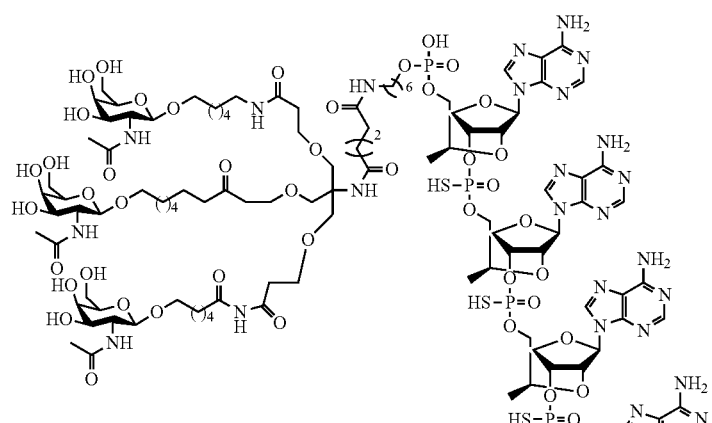
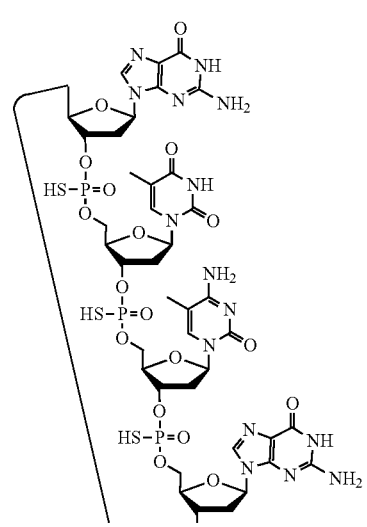
104
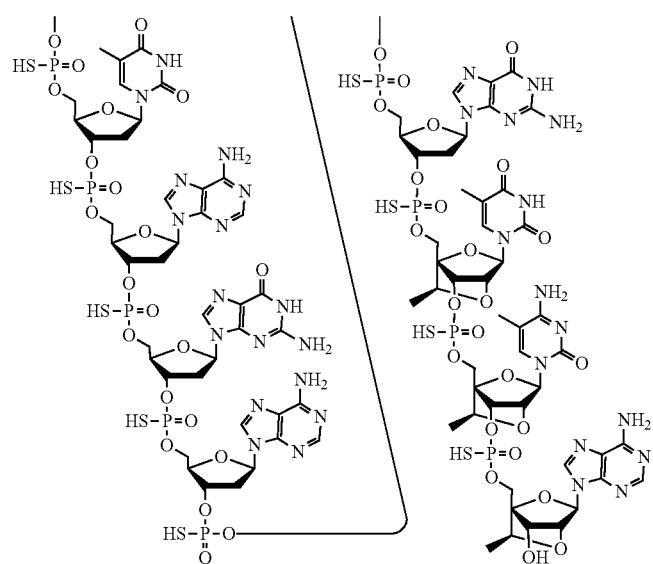
Embodiment 45: Certain embodiments provide the compound having the following chemical structure or salt thereof:

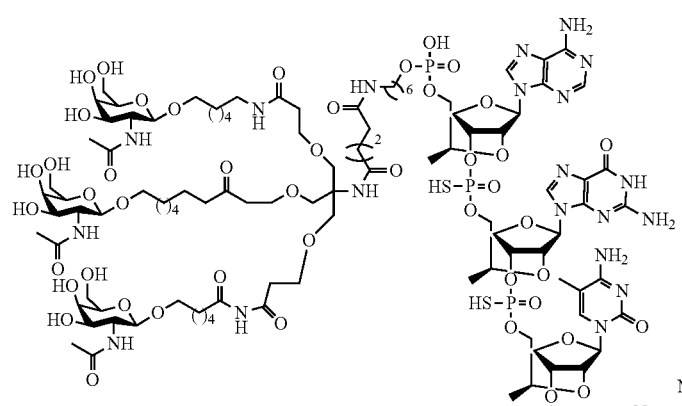
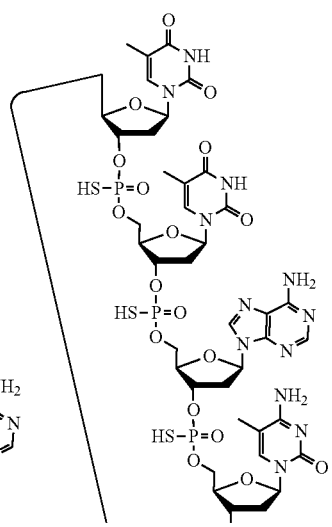
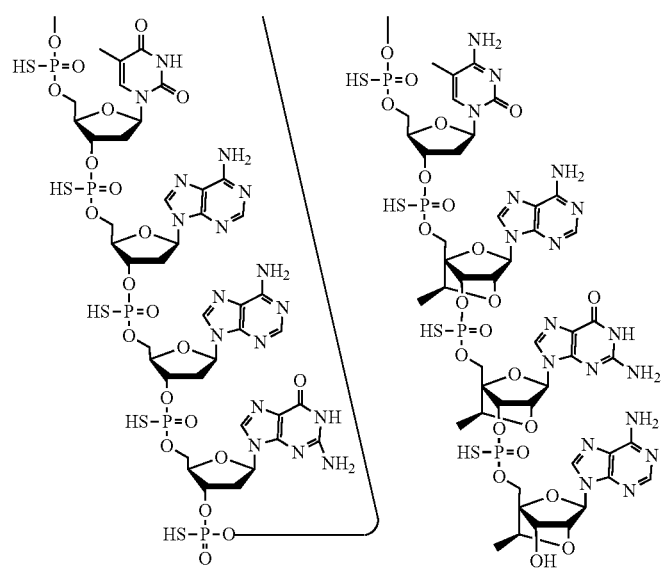
Embodiment 46: Certain embodiments provide the compound having the following chemical structure or salt thereof:

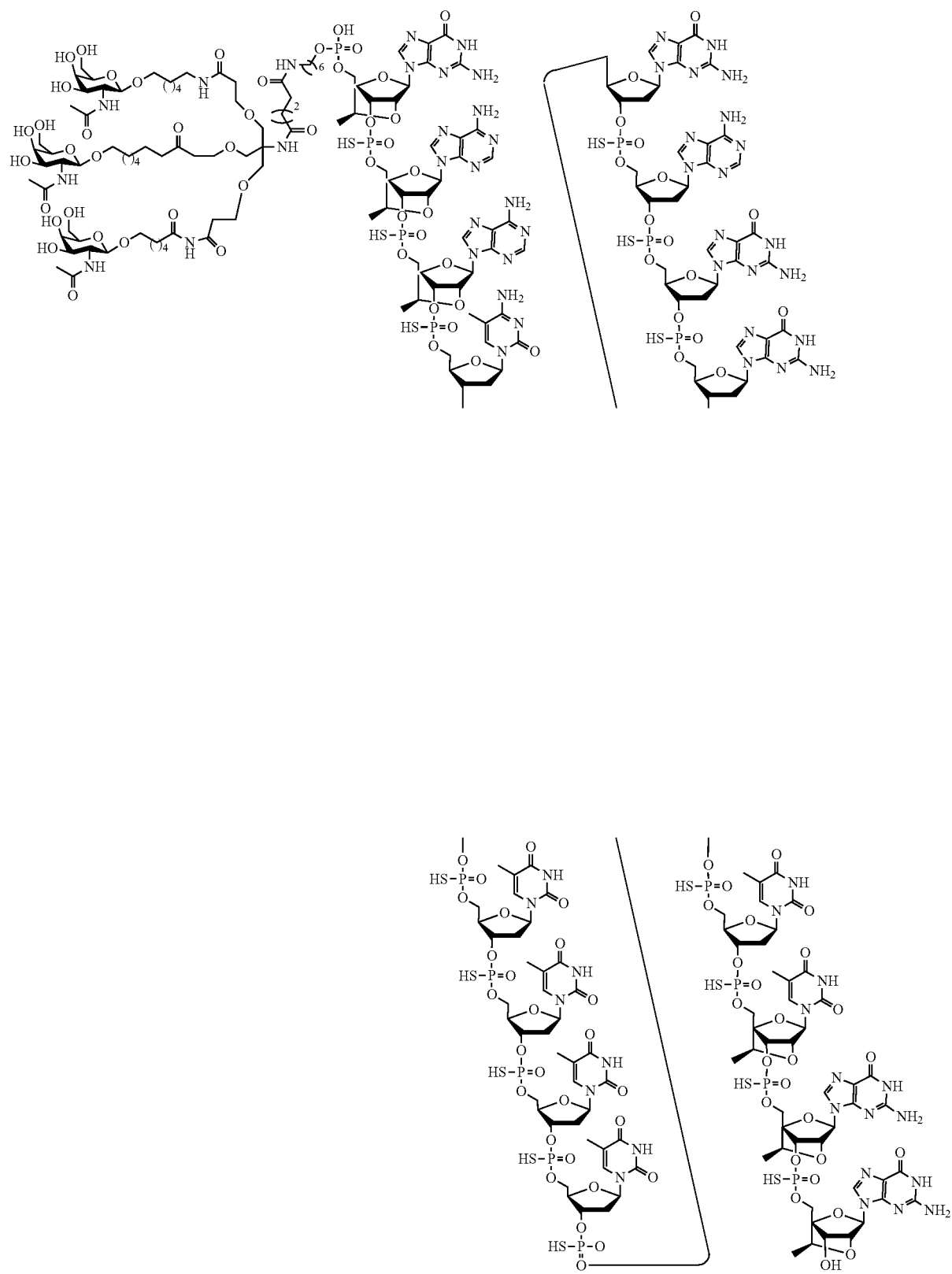
Embodiment 47: Certain embodiments provide the compound having the following chemical structure or salt thereof:

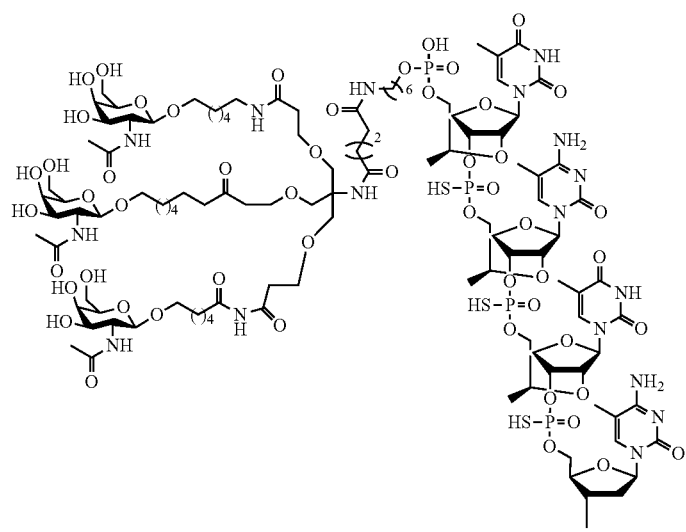
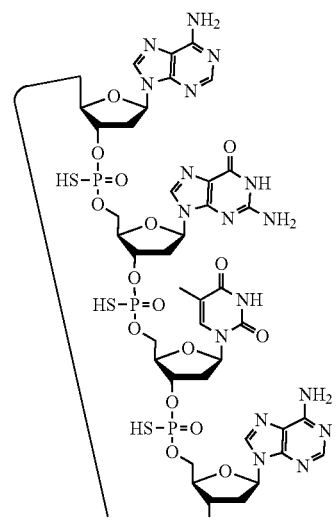
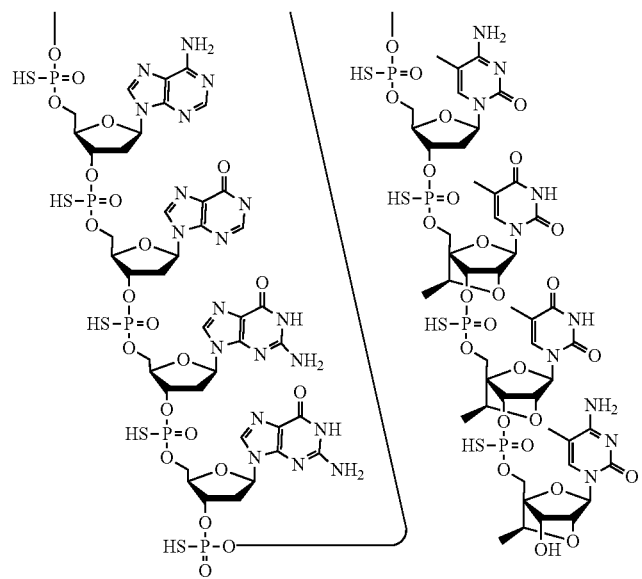
Embodiment 48: Certain embodiments provide the compound having the following chemical structure or salt thereof:

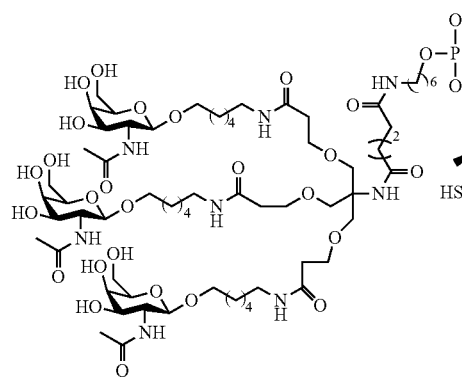
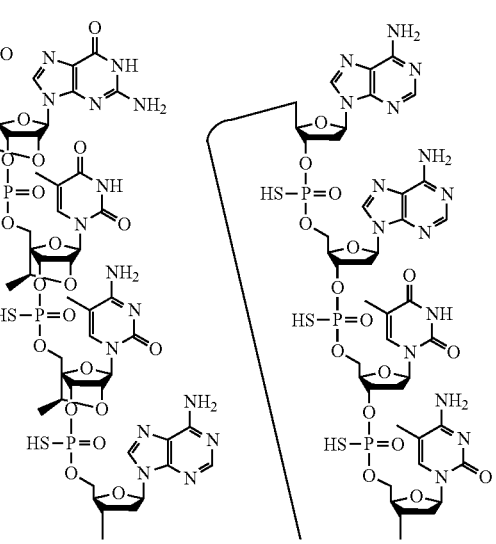
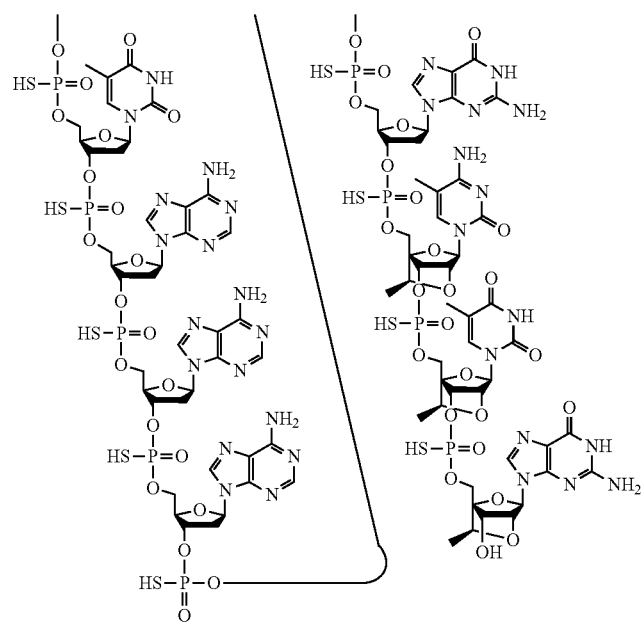
Embodiment 49: Certain embodiments provide the compound having the following chemical structure or salt thereof:

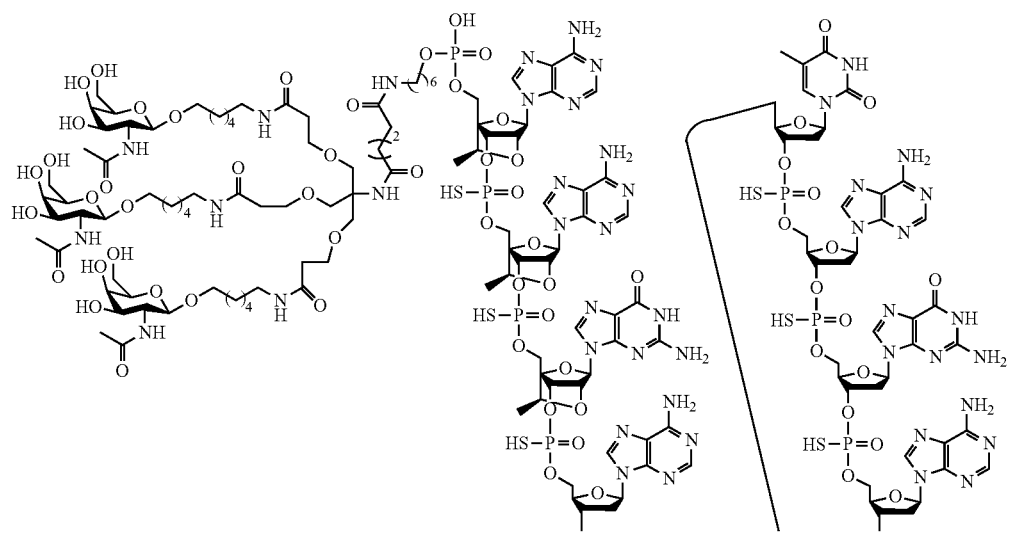
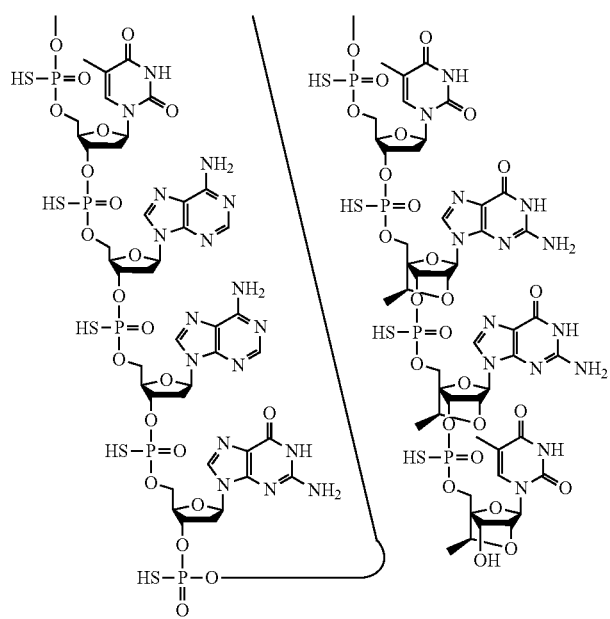
Embodiment 50: Certain embodiments provide the compound having the following chemical structure or salt thereof:

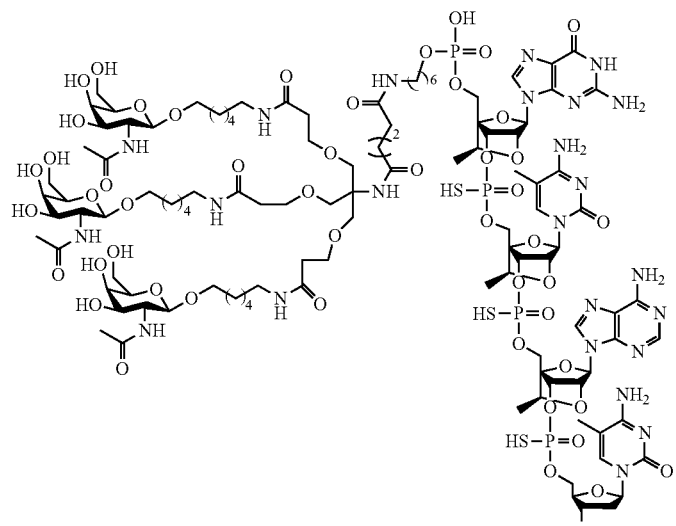
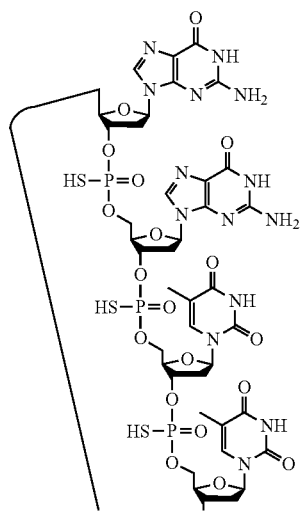
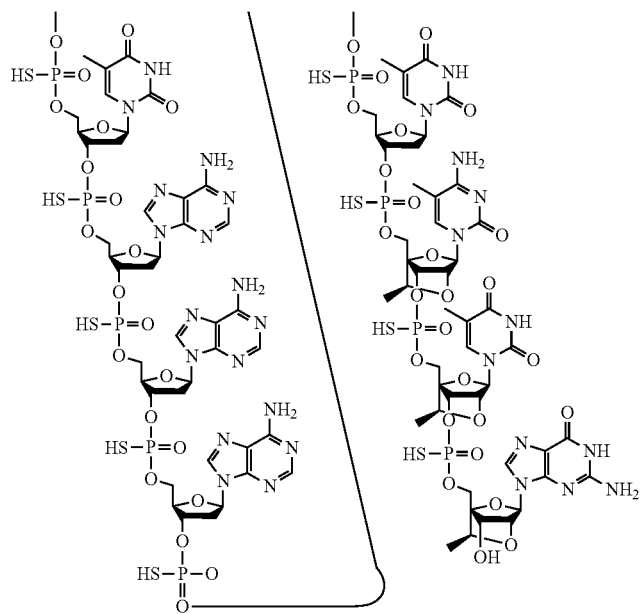
Embodiment 51: Certain embodiments provide the compound having the following chemical structure or salt thereof:

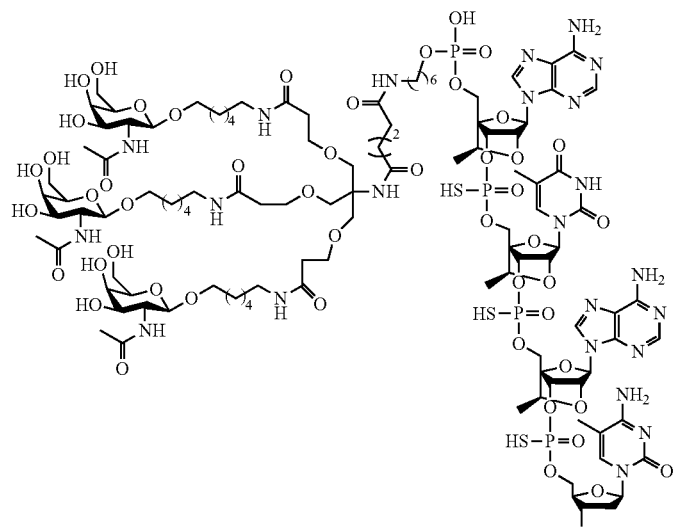
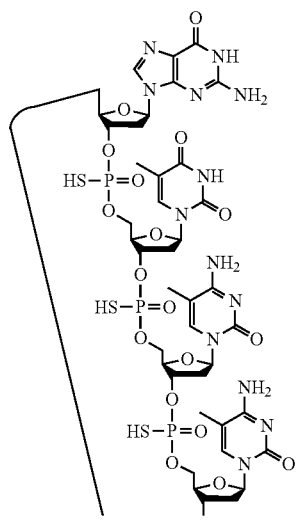
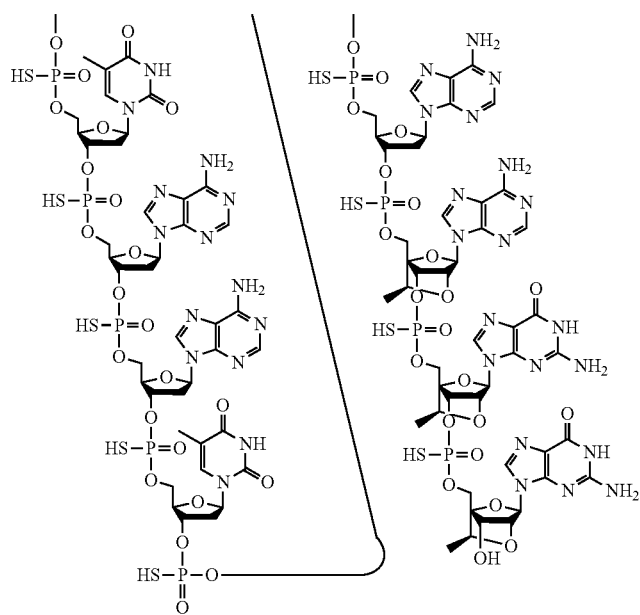
Embodiment 52: Certain embodiments provide the compound having the following chemical structure or salt thereof:

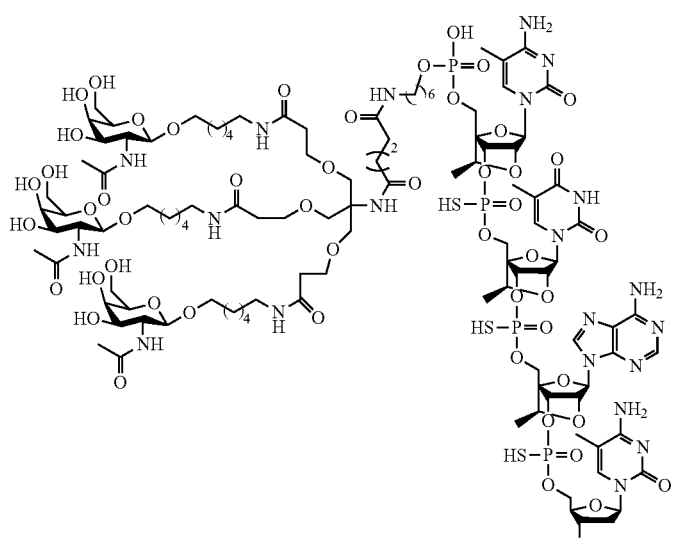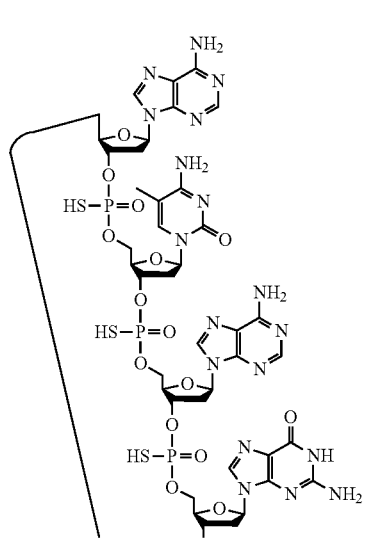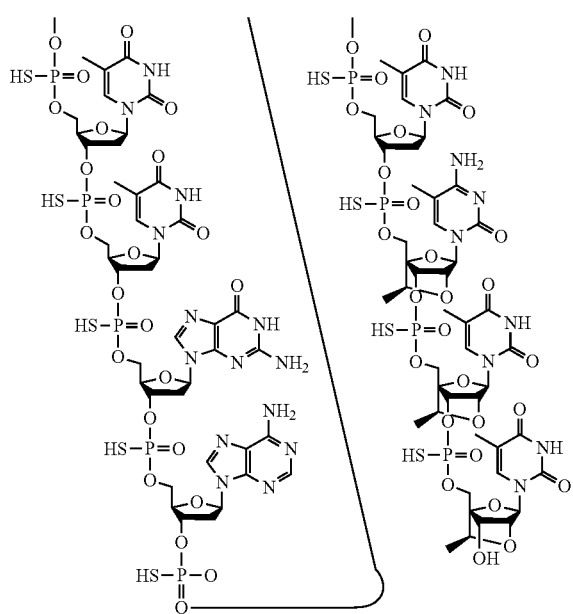
Embodiment 53: Certain embodiments provide the compound having the following chemical structure or salt thereof:

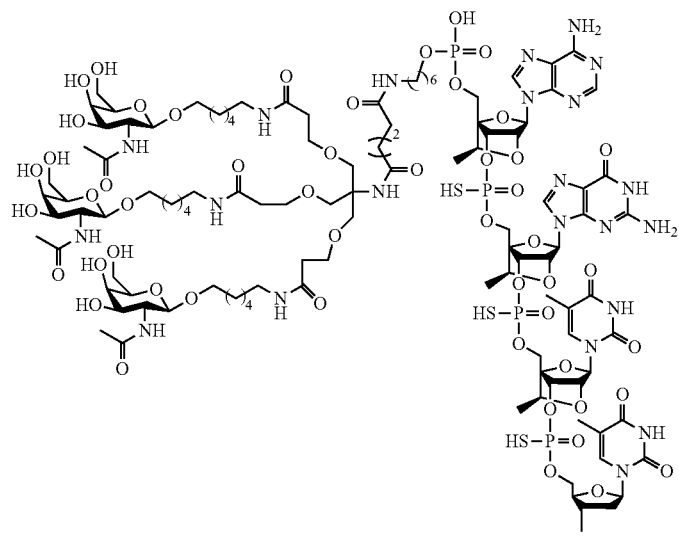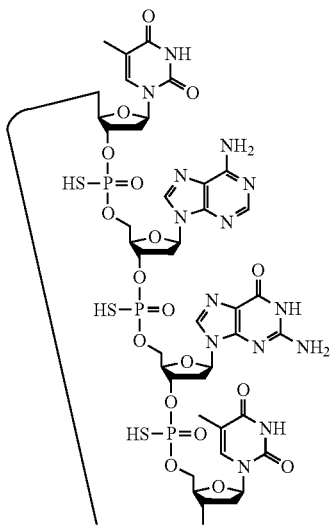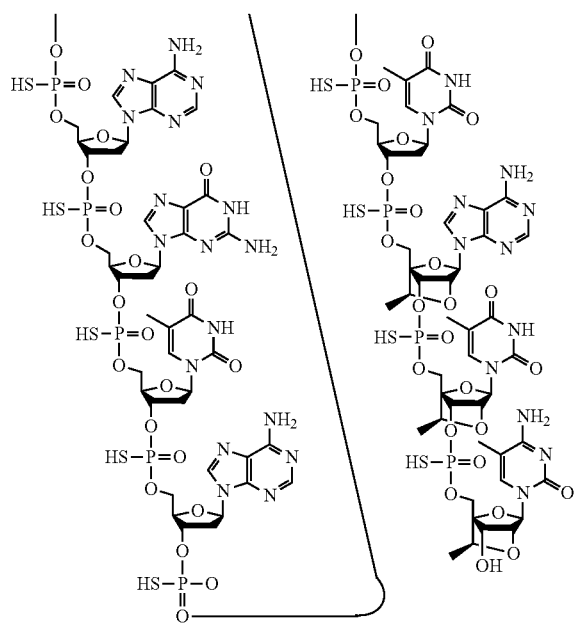
Embodiment 54: Certain embodiments provide the compound having the following chemical structure or salt thereof:

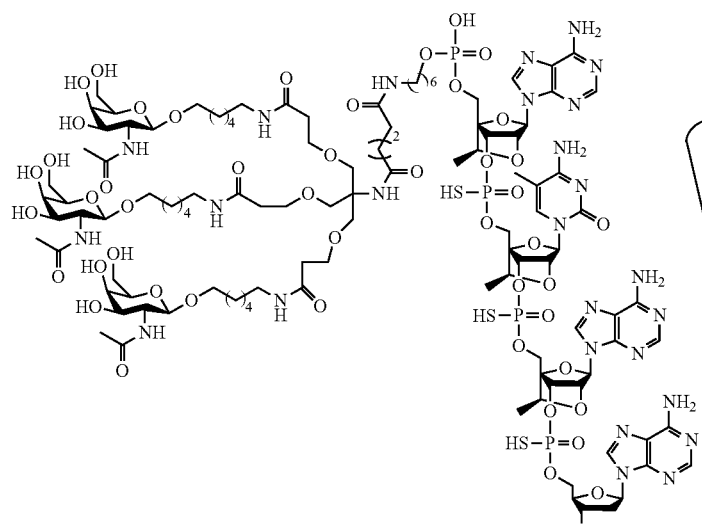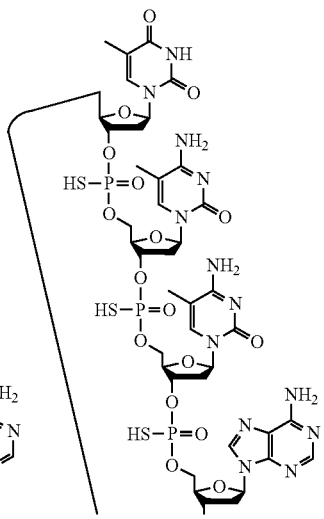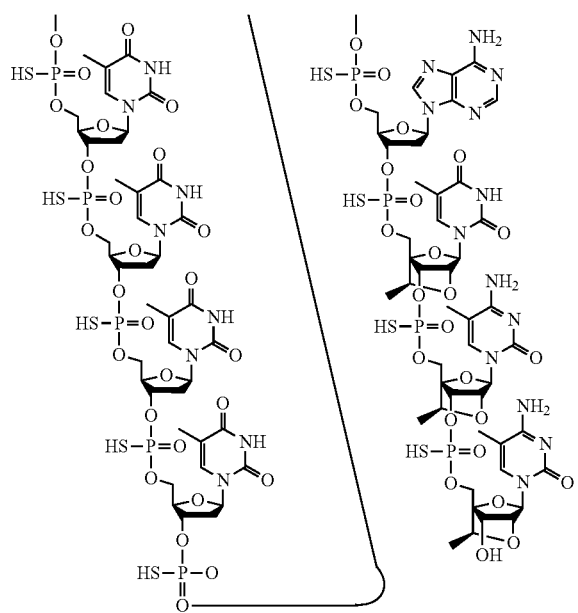
Embodiment 55: Certain embodiments provide the compound having the following chemical structure or salt thereof:

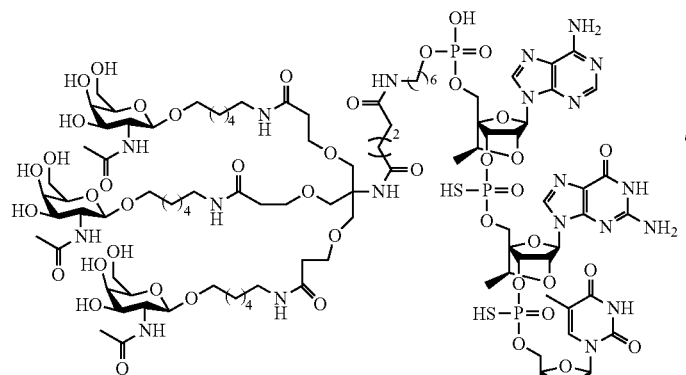
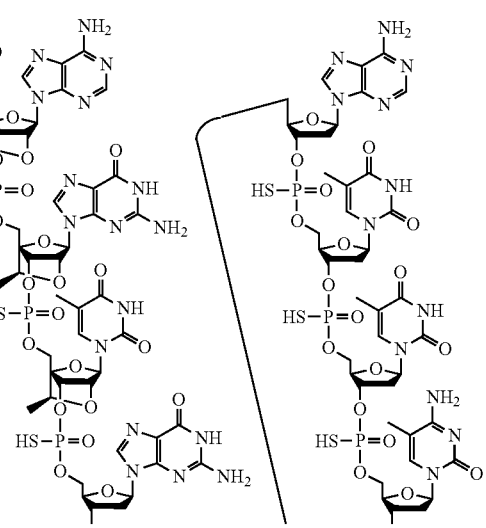
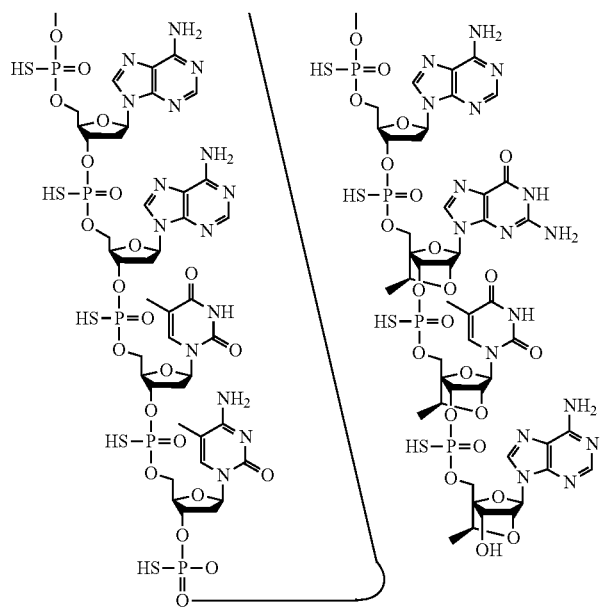
Embodiment 56: Certain embodiments provide the compound having the following chemical structure or salt thereof:

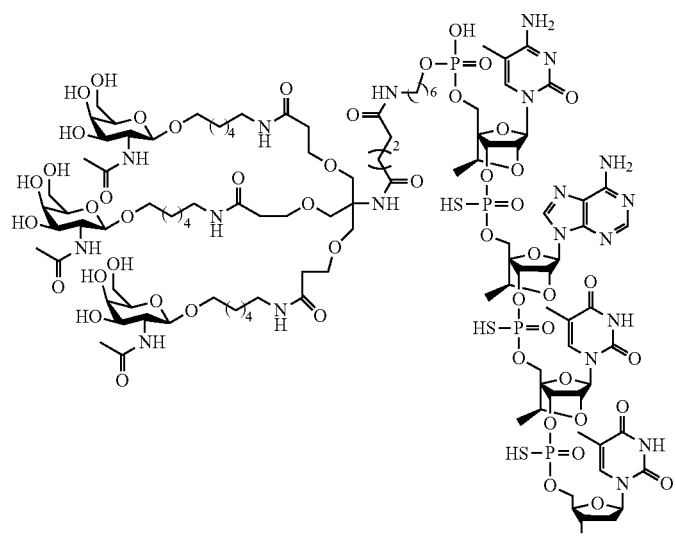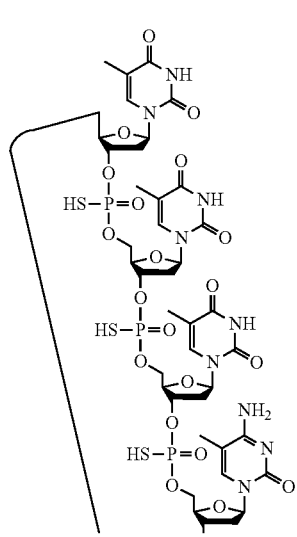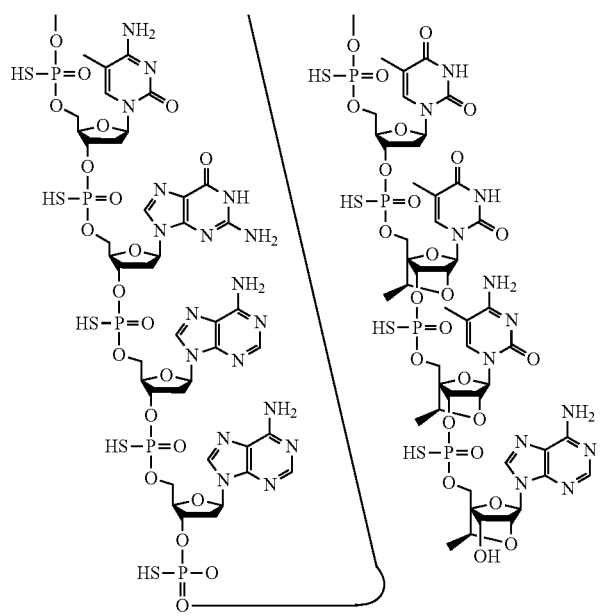
Embodiment 57: Certain embodiments provide the compound having the following chemical structure or salt thereof:

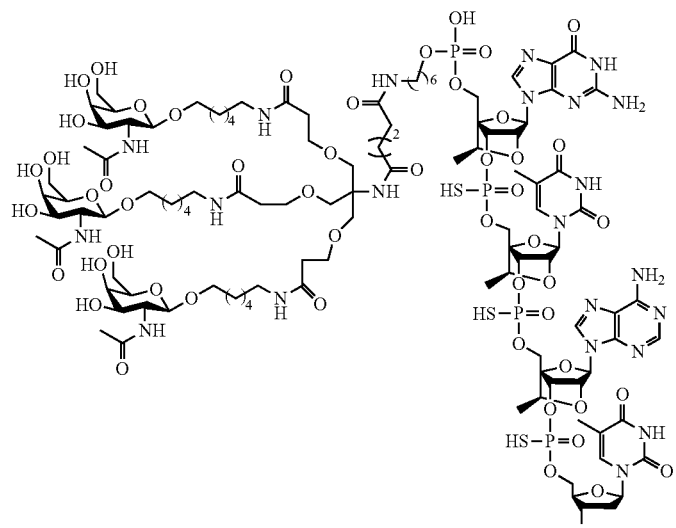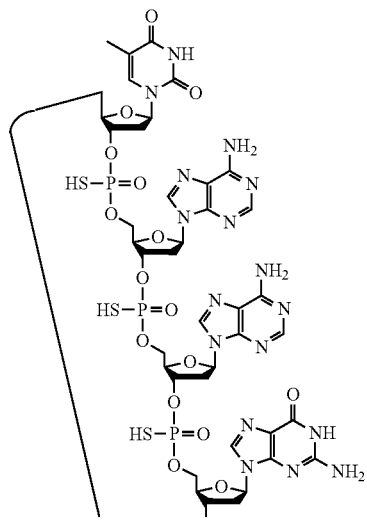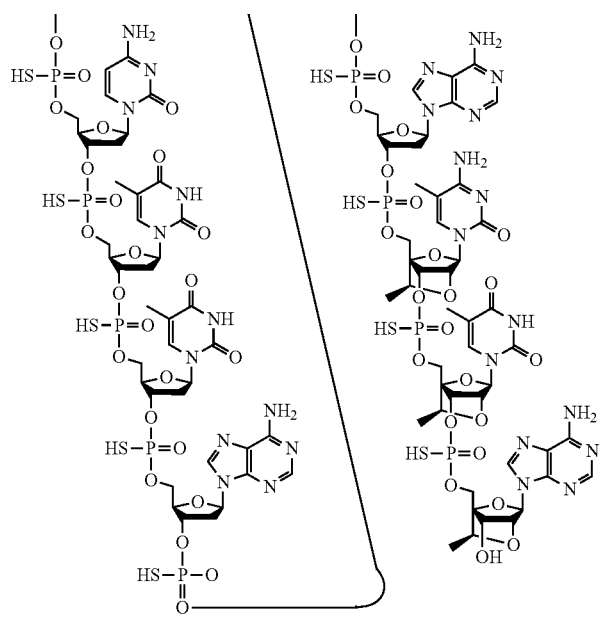
Embodiment 58: Certain embodiments provide the compound having the following chemical structure or salt thereof:

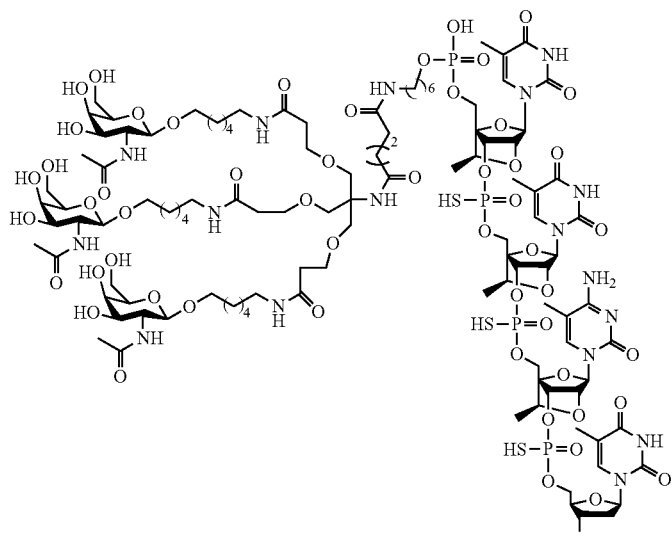
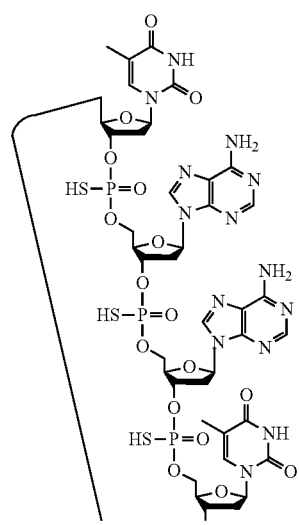
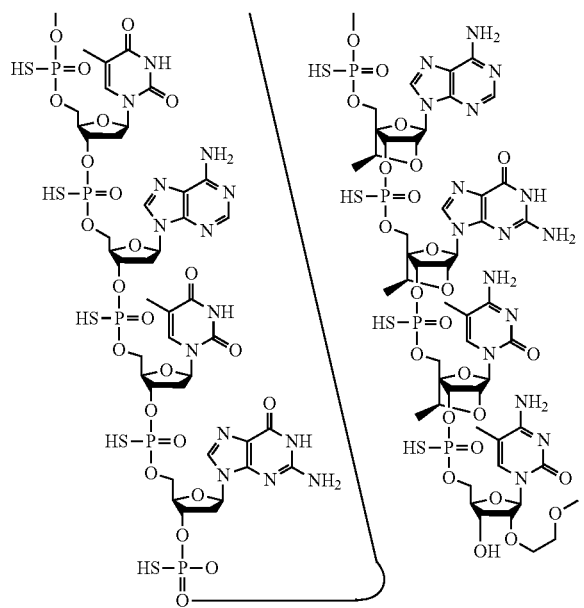
Embodiment 59: Certain embodiments provide the compound having the following chemical structure or salt thereof:

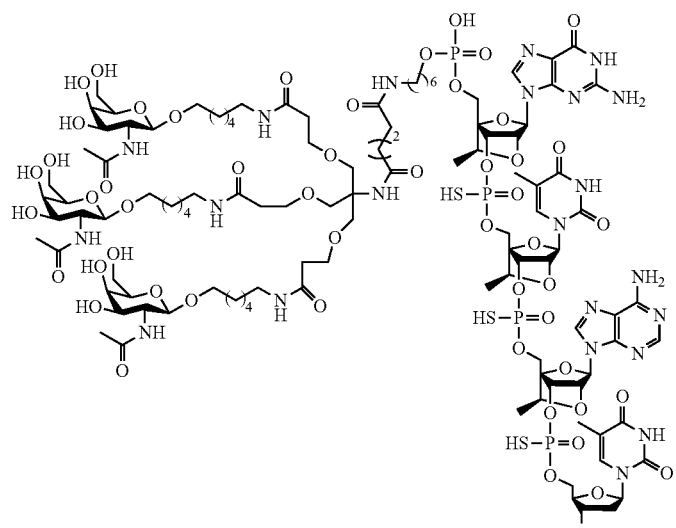
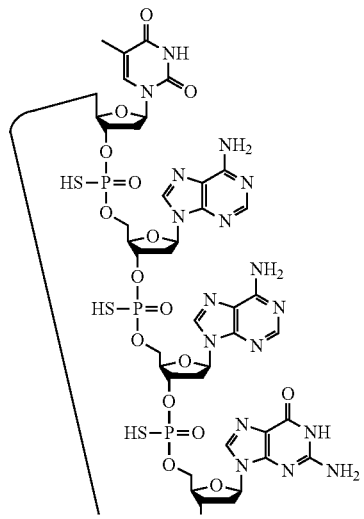
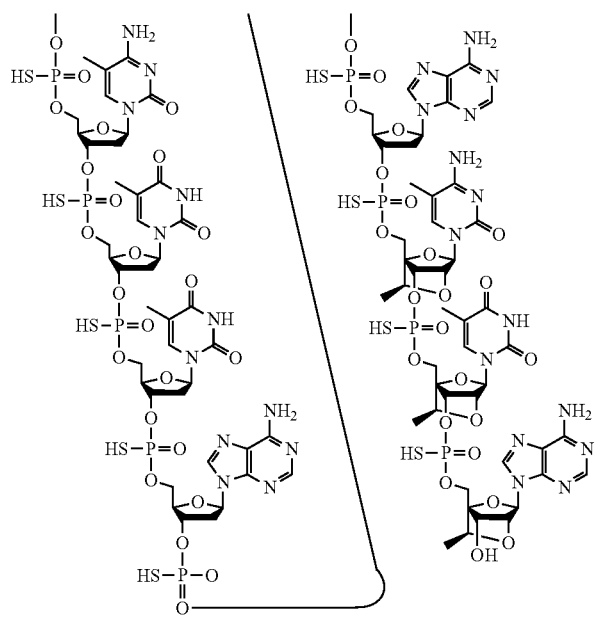
Embodiment 60: Certain embodiments provide the compound having the following chemical structure or salt thereof:

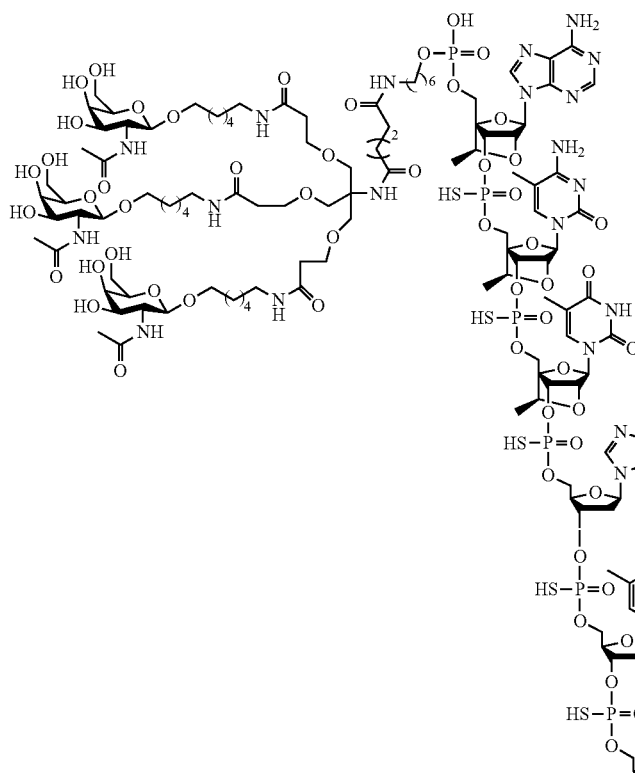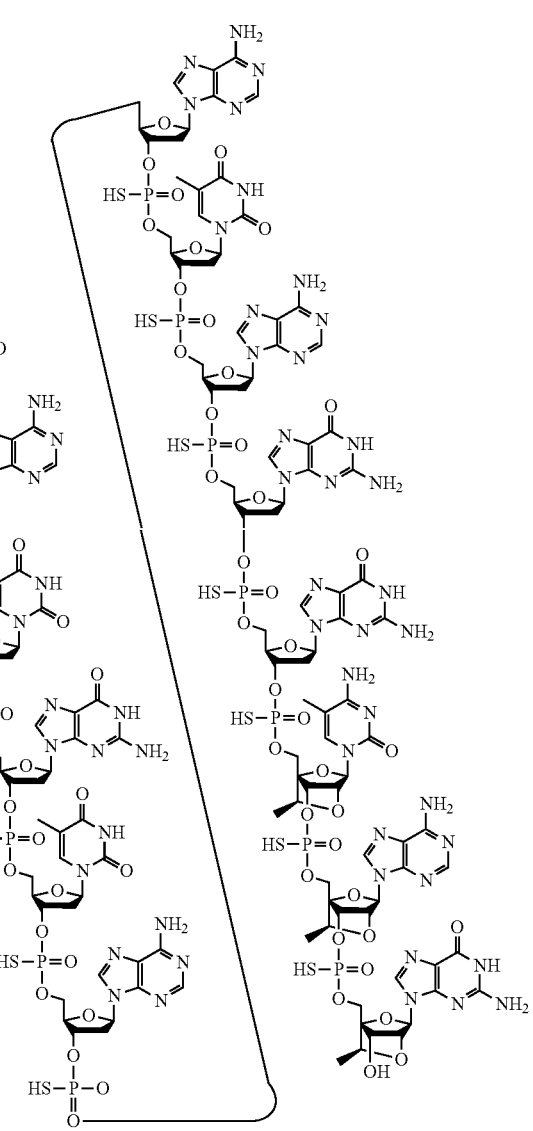

Embodiment 61: Certain embodiments provide the compound of any one of the embodiments 43-60, wherein the compound is a sodium salt.

Embodiment 62: Certain embodiments provide the compound of any one of the embodiments 43-60, wherein the compound is a potassium salt.

Embodiment 63: Certain embodiments provide the chirally enriched population of the compound of any one of embodiments 1-62, wherein the population is enriched for compounds having a modified oligonucleotide comprising at least one particular phosphorothioate internucleoside linkage having a particular stereochemical configuration.

Embodiment 64: Certain embodiments provide the chirally enriched population of embodiment 63, wherein the population is enriched for compounds having a modified oligonucleotide comprising at least one particular phosphorothioate internucleoside linkage having the (Sp) configuration.

Embodiment 65: Certain embodiments provide the chirally enriched population of embodiment 63 or embodiment 64, wherein the population is enriched for compounds having a modified oligonucleotide comprising at least one particular phosphorothioate internucleoside linkage having the (Rp) configuration.

Embodiment 66: Certain embodiments provide the chirally enriched population of embodiment 63, wherein the population is enriched for compounds having a modified oligonucleotide having a particular, independently selected stereochemical configuration at each phosphorothioate internucleoside linkage.

Embodiment 67: Certain embodiments provide the chirally enriched population of embodiment 66, wherein the population is enriched for oligomeric compounds having a modified oligonucleotide having the (Sp) configuration at each phosphorothioate internucleoside linkage.

Embodiment 68: Certain embodiments provide the chirally enriched population of embodiment 66, wherein the population is enriched for oligomeric compounds having a modified oligonucleotide having the (Rp) configuration at each phosphorothioate internucleoside linkage.

Embodiment 69: Certain embodiments provide the chirally enriched population of embodiment 63 or 66, wherein the population is enriched for oligomeric compounds having a modified oligonucleotide having at least 3 contiguous phosphorothioate internucleoside linkages in the Sp-Sp-Rp configurations, in the 5' to 3' direction.

Embodiment 70: Certain embodiments provide a population of compounds having a modified oligonucleotide of any of embodiments 69, wherein all of the phosphorothioate internucleoside linkages of the modified oligonucleotide are stereorandom.

Embodiment 71: Certain embodiments provide a composition comprising the compound of any one of embodiments 1-70 and a pharmaceutically acceptable carrier.

Embodiment 72: Certain embodiments provide a composition comprising a compound of any preceding embodiment, for use in therapy.

Embodiment 73: Certain embodiments provide a method of treating, preventing, or ameliorating a disease associated with HSD17B13 in an individual comprising administering to the individual a compound complementary to HSD17B13, thereby treating, preventing, or ameliorating the disease.

Embodiment 74: Certain embodiments provide a method of administering the compound of embodiments 1-70 or composition of embodiment 71 or embodiment 72 to an individual.

Embodiment 75: Certain embodiments provide the method of embodiments 73 or 74, wherein the individual has a liver disease, NAFLD, NASH, hepatic steatosis, hepatocellular carcinoma, alcoholic liver disease, HCV hepatitis, chronic hepatitis, hereditary hemochromatosis, or primary sclerosing cholangitis.

Embodiment 76: Certain embodiments provide the method of embodiment 73 or embodiment 74, wherein the compound is an antisense compound.

Embodiment 77: Certain embodiments provide the method of any of embodiments 73-76, wherein administering the compound ameliorates liver damage, steatosis, liver fibrosis, liver inflammation, liver scarring or cirrhosis, liver failure, liver enlargement, elevated transaminases, or hepatic fat accumulation in the individual.

Embodiment 78: Certain embodiments provide a method of inhibiting expression of HSD17B13 in a cell comprising contacting the cell with a compound comprising a modified oligonucleotide complementary to HSD17B13, thereby inhibiting expression of HSD17B13 in the cell.

Embodiment 79: Certain embodiments provide the method of embodiment 78, wherein the cell is in the liver of an individual.

Embodiment 80: Certain embodiments provide the method of embodiment 79, wherein the individual has, or is at risk of having, liver disease, NAFLD, NASH, hepatic steatosis, hepatocellular carcinoma, alcoholic liver disease, HCV hepatitis, chronic hepatitis, hereditary hemochromatosis, or primary sclerosing cholangitis.

Embodiment 81: Certain embodiments provide a method of ameliorating, reducing or inhibiting liver damage, steatosis, liver fibrosis, liver inflammation, liver scarring or cirrhosis, liver failure, liver enlargement, elevated transaminases, or hepatic fat accumulation in an individual, comprising administering a compound comprising a modified oligonucleotide complementary to HSD17B13 to the individual, thereby reducing or inhibiting liver damage, steatosis, liver fibrosis, liver inflammation, liver scarring or cirrhosis, liver failure, liver enlargement, elevated transaminases, or hepatic fat accumulation in the individual.

Embodiment 82: Certain embodiments provide the method of embodiment 81, wherein the individual has, or is at risk of having, liver disease, NAFLD, NASH, hepatic steatosis, hepatocellular carcinoma, alcoholic liver disease, HCV hepatitis, chronic hepatitis, hereditary hemochromatosis, or primary sclerosing cholangitis.

Embodiment 83: Certain embodiments provide the method of any one of embodiments 78-82, wherein the compound is an antisense compound.

Embodiment 84: Certain embodiments provide the method of any one of embodiments 78-83, wherein the compound is the compound of any one of embodiments 1-70 or composition of embodiment 71 or embodiment 72.

Embodiment 85: Certain embodiments provide the method of embodiment 83 or embodiment 84, wherein the compound or composition is administered parenterally.

Embodiment 86: Certain embodiments provide the use of a compound comprising a modified oligonucleotide complementary to HSD17B13 for treating, preventing, or ameliorating a disease associated with HSD17B13.

Embodiment 87: Certain embodiments provide the use of embodiment 86, wherein the disease is liver disease, NAFLD, NASH, hepatic steatosis, hepatocellular carcinoma, alcoholic liver disease, HCV hepatitis, chronic hepatitis, hereditary hemochromatosis, or primary sclerosing cholangitis.

Embodiment 88: Certain embodiments provide the use of embodiments 86 or 87, wherein the compound is an antisense compound.

Embodiment 89: Certain embodiments provide the use of any one of embodiments 86-88, wherein the compound is the compound of any one of embodiments 1-70 or composition of embodiment 71 or embodiment 72.

Embodiment 90: Certain embodiments provide the use of a compound comprising a modified oligonucleotide complementary to HSD17B13 in the manufacture of a medicament for treating, preventing, or ameliorating a disease associated with HSD17B13.

Embodiment 91: Certain embodiments provide the use of embodiment 90, wherein the disease is liver disease, NAFLD, NASH, hepatic steatosis, hepatocellular carcinoma, alcoholic liver disease, HCV hepatitis, chronic hepatitis, hereditary hemochromatosis, or primary sclerosing cholangitis.

Embodiment 92: Certain embodiments provide the use of embodiments 90 or 91, wherein the compound is an antisense compound.

Embodiment 93: Certain embodiments provide the use of any one of embodiments 90-92, wherein the compound is the compound of any one of embodiments 1-70 or composition of embodiment 71 or embodiment 72.

Certain Indications

Certain embodiments provided herein relate to methods of inhibiting HSD17B13 expression, which can be useful for treating, preventing, or ameliorating a disease associated with HSD17B13 in an individual, by administration of a compound that targets HSD17B13. In certain embodiments, the compound can be a HSD17B13 specific inhibitor. In certain embodiments, the compound can be an antisense compound, an oligomeric compound, or an oligonucleotide targeted to HSD17B13.

Examples of diseases associated with HSD17B13 treatable, preventable, and/or ameliorable with the methods provided herein include liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. Certain compounds provided herein are directed to compounds and compositions that reduce liver damage, steatosis, liver fibrosis, liver inflammation, liver scarring or cirrhosis, liver failure, liver enlargement, elevated transaminases, or hepatic fat accumulation in an animal.

In certain embodiments, a method of treating, preventing, or ameliorating a disease associated with HSD17B13 in an individual comprises administering to the individual a compound comprising a HSD17B13 specific inhibitor, thereby treating, preventing, or ameliorating the disease. In certain embodiments, the individual is identified as having, or at risk of having, a disease associated with HSD17B13. In certain embodiments, the disease is a liver disease. In certain embodiments, the compound comprises an antisense compound targeted to HSD17B13. In certain embodiments, the compound comprises an oligonucleotide targeted to HSD17B13. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound improves, preserves, or prevents liver damage, steatosis, liver fibrosis, cirrhosis, elevated transaminases, or hepatic fat accumulation in an animal.

In certain embodiments, a method of treating, preventing, or ameliorating liver damage, steatosis, liver fibrosis, cirrhosis, elevated transaminases, or hepatic fat accumulation in an animal comprises administering to the individual a compound comprising a HSD17B13 specific inhibitor, thereby treating, preventing, or ameliorating liver damage, steatosis, liver fibrosis, cirrhosis, elevated transaminases, or hepatic fat accumulation. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound improves, preserves, or prevents liver damage, steatosis, liver fibrosis, cirrhosis, elevated transaminases, or hepatic fat accumulation. In certain embodiments, the individual is identified as having, or at risk of having, a disease associated with HSD17B13.

In certain embodiments, a method of inhibiting expression of HSD17B13 in an individual having, or at risk of having, a disease associated with HSD17B13 comprises administering to the individual a compound comprising a HSD17B13 specific inhibitor, thereby inhibiting expression of HSD17B13 in the individual. In certain embodiments, administering the compound inhibits expression of HSD17B13 in the liver. In certain embodiments, the disease is a liver disease. In certain embodiments, the individual has, or is at risk of having, liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. In certain embodiments, the individual has, or is at risk of having, liver damage, steatosis, liver fibrosis, cirrhosis, elevated transaminases, or hepatic fat accumulation. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound improves, preserves, or prevents liver damage, steatosis, liver fibrosis, cirrhosis, elevated transaminases, or hepatic fat accumulation.

In certain embodiments, a method of inhibiting expression of HSD17B13 in a cell comprises contacting the cell with a compound comprising a HSD17B13 specific inhibitor, thereby inhibiting expression of HSD17B13 in the cell. In certain embodiments, the cell is a hepatocyte. In certain embodiments, the cell is in the liver. In certain embodiments, the cell is in the liver of an individual who has, or is at risk of having, liver damage, steatosis, liver fibrosis, cirrhosis, elevated transaminases, or hepatic fat accumulation. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound.

In certain embodiments, a method of reducing or inhibiting liver damage, steatosis, liver fibrosis, cirrhosis, elevated transaminases, or hepatic fat accumulation in an individual having, or at risk of having, a disease associated with HSD17B13 comprises administering to the individual a compound comprising a HSD17B13 specific inhibitor, thereby reducing or inhibiting liver damage, steatosis, liver fibrosis, cirrhosis, elevated transaminases, or hepatic fat accumulation in the individual. In certain embodiments, the individual has, or is at risk of having, liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having, or at risk of having, a disease associated with HSD17B13.

Certain embodiments are drawn to a compound comprising a HSD17B13 specific inhibitor for use in treating a disease associated with HSD17B13. In certain embodiments, the disease is liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound. In certain embodiments, the compound is administered to the individual parenterally.

Certain embodiments are drawn to a compound comprising a HSD17B13 specific inhibitor for use in reducing or inhibiting liver damage, steatosis, liver fibrosis, cirrhosis, elevated transaminases, or hepatic fat accumulation in an individual having, or at risk of having, liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound.

Certain embodiments are drawn to the use of a compound comprising a HSD17B13 specific inhibitor for the manufacture or preparation of a medicament for treating a disease associated with HSD17B13. Certain embodiments are drawn to the use of a compound comprising a HSD17B13 specific inhibitor for the preparation of a medicament for treating a disease associated with HSD17B13. In certain embodiments, the disease is a liver disease. In certain embodiments, the disease is liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound.

Certain embodiments are drawn to the use of a compound comprising a HSD17B13 specific inhibitor for the manufacture or preparation of a medicament for reducing or inhibiting liver damage, steatosis, liver fibrosis, cirrhosis, elevated transaminases, or hepatic fat accumulation in an individual having, or at risk of having, a disease associated with HSD17B13. In certain embodiments, the disease is liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. Certain embodiments are drawn to use of a compound comprising a HSD17B13 specific inhibitor for the preparation of a medicament for treating a disease associated with HSD17B13. In certain embodiments, the disease is liver disease, NAFLD, NASH, alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis. In certain embodiments, the compound comprises an antisense compound targeted to HSD17B13. In certain embodiments, the compound comprises an oligonucleotide targeted to HSD17B13. In certain embodiments, a compound comprises consisting of 8 to 80 linked nucleosides and having a nucleobase sequence comprising at least 8 contiguous nucleobases of any of the nucleobase sequences of SEQ ID NOs: 8-2896. In certain embodiments, a compound comprises a modified oligonucleotide consisting of 16 to 80 linked nucleosides and having a nucleobase sequence comprising the nucleobase sequence of any one of SEQ ID NOs: 8-2896. In certain embodiments, a compound comprises a modified oligonucleotide consisting of the nucleobase sequence of any one of SEQ ID NOs: 8-2896. In any of the foregoing embodiments, the compound can be single-stranded or double-stranded. In any of the foregoing embodiments, the compound can be an antisense compound or oligomeric compound.

In any of the foregoing methods or uses, the compound can be targeted to HSD17B13. In certain embodiments, the compound comprises or consists of a modified oligonucleotide, for example, a modified oligonucleotide consisting of 8 to 80 linked nucleosides, 10 to 30 linked nucleosides, 12 to 30 linked nucleosides, or 20 linked nucleosides. In certain embodiments, the modified oligonucleotide is at least 80%, at least 85%, at least 90%, at least 95% or 100% complementary to any of the nucleobase sequences recited in SEQ ID NOs: 1-4. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl modified sugar, and the modified nucleobase is a 5-methylcytosine. In certain embodiments, the modified oligonucleotide comprises a gap segment consisting of linked deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide consists of 12 to 30, 15 to 30, 15 to 25, 15 to 24, 16 to 24, 17 to 24, 18 to 24, 19 to 24, 20 to 24, 19 to 22, 20 to 22, 16 to 20, or 16 or 20 linked nucleosides. In certain embodiments, the modified oligonucleotide is at least 80%, at least 85%, at least 90%, at least 95% or 100% complementary to any of the nucleobase sequences recited in SEQ ID NOs: 1-4.

In any of the foregoing methods or uses, the compound comprises or consists of a modified oligonucleotide consisting of 16 to 30 linked nucleosides and having a nucleobase sequence comprising any one of SEQ ID NOs: 8-2896, wherein the modified oligonucleotide has:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide is 16-30 linked nucleosides in length and the second modified oligonucleotide is 16-30 linked nucleosides in length. In certain embodiments, one of the modified oligonucleotides has a nucleobase sequence comprising at least 8 contiguous nucleobases of any of SEQ ID NOs: 8-2035.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such a double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include, but are not limited to, oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 12 to 30 linked subunits in length. In certain embodiments, a compound described herein comprises an oligonucleotide 12 to 22 linked subunits in length. In certain embodiments, a compound described herein comprises an oligonucleotide 14 to 30 linked subunits in length. In certain embodiments, compound described herein comprises an oligonucleotide 14 to 20 linked subunits in length. In certain embodiments, a compound described herein comprises an oligonucleotide 15 to 30 linked subunits in length. In certain embodiments, a compound described herein comprises an oligonucleotide 15 to 20 linked subunits in length. In certain embodiments, a compound described herein comprises an oligonucleotide 16 to 30 linked subunits in length. In certain embodiments, a compound described herein comprises an oligonucleotide 16 to 20 linked subunits in length. In certain embodiments, a compound described herein comprises an oligonucleotide 17 to 30 linked subunits in length. In certain embodiments, a compound described herein comprises an oligonucleotide 17 to 20 linked subunits in length. In certain embodiments, a compound described herein comprises an oligonucleotide 18 to 30 linked subunits in length. In certain embodiments, a compound described herein comprises an oligonucleotide 18 to 20 linked subunits in length. In certain embodiments, a compound described herein comprises an oligonucleotide 20 to 30 linked subunits in length. In other words, such oligonucleotides are 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, or 20 to 30 subunits in length, respectively. In certain embodiments, a compound described herein comprises an oligonucleotide 14 linked subunits in length. In certain embodiments, a compound described herein comprises an oligonucleotide 16 linked subunits in length. In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, or 30 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to a HSD17B13 nucleic acid may have two subunits deleted from the 5' end, or alternatively, may have two subunits deleted from the 3' end of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively, to the 3' end (3' addition) of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst. March* 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence-specific RNAi, for example, short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence-specific RNA interference, such as post transcriptional gene silencing, translational inhibition, or epigenetics.

In certain embodiments, a compound described herein can comprise any of the oligonucleotide sequences targeted to HSD17B13 described herein. In certain embodiments, the compound can be double-stranded. In certain embodiments, the compound comprises a first strand comprising at least an 8, 9, 10, 11, 12, 13, 14, 15, or 16 contiguous nucleobase portion of any one of SEQ ID NOs: 8-2035 and a second strand. In certain embodiments, the compound comprises a first strand comprising the nucleobase sequence of any one of SEQ ID NOs: 8-2035 and a second strand. In certain embodiments, the compound comprises ribonucleotides in which the first strand has uracil (U) in place of thymine (T) in any one of SEQ ID NOs: 8-2035. In certain embodiments, the compound comprises (i) a first strand comprising a nucleobase sequence complementary to the site on HSD17B13 to which any of SEQ ID NOs: 8-2035 is targeted, and (ii) a second strand. In certain embodiments, the compound comprises one or more modified nucleotides in which the 2' position of the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound is 16, 17, 18, 19, 20, 21, 22, or 23 linked nucleosides in length. In certain embodiments, the first or second strand of the compound can comprise a conjugate group.

In certain embodiments, a compound described herein can comprise any of the oligonucleotide sequences targeted to HSD17B13 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, or 16 contiguous nucleobase portion of any one of SEQ ID NOs: 8-2035. In certain embodiments, the compound comprises the nucleobase sequence of any one of SEQ ID NOs: 8-2035. In certain embodiments, the compound comprises ribonucleotides in which uracil (U) is in place of thymine (T) in any one of SEQ ID NOs: 8-2035. In certain embodiments, the compound comprises a nucleobase sequence complementary to the site on HSD17B13 to which any of SEQ ID NOs: 8-2035 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode HSD17B13 include, without limitation, the following: RefSeq or GENBANK Accession No. NM_178135.4 (incorporated by reference, disclosed herein as SEQ ID NO: 1), the complement of GENBANK Accession No. NC_000004.12 truncated from nucleotides 87301001 to 87326000 (incorporated by reference, disclosed herein as SEQ ID NO: 2), the sequence listed as SEQ ID NO: 3, or GENBANK Accession No. NM_001136230.2 (incorporated by reference, disclosed herein as SEQ ID NO: 4).

Hybridization

In some embodiments, hybridization occurs between a compound disclosed herein and a HSD17B13 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a HSD17B13 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G), unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a HSD17B13 nucleic acid may be tolerated provided that the compound remains able to specifically hybridize to a target nucleic acid. Moreover, a compound may hybridize over one or more segments of a HSD17B13 nucleic acid such that intervening or adjacent segments are not involved in the hybridization event (e.g., a loop structure, mismatch or hairpin structure).

In certain embodiments, the compounds provided herein, or a specified portion thereof are at least, or are up to 70%, 80%, 85%, 86%, 87%, 88%, 89%, 90%, 91%, 92%, 93%, 94%, 95%, 96%, 97%, 98%, 99%, or 100% complementary to a HSD17B13 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a HSD17B13 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a HSD17B13 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. "Fully complementary" can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments, selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a HSD17B13 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a HSD17B13 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 17, 18, 19, 20, or more nucleobase portion of a target segment, or a range defined by any two of these values.

Identity

The compounds provided herein may also have a defined percent identity to a particular nucleotide sequence, SEQ ID NOs, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of an compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases.

In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified furanosyl sugar moieties comprising one or more acyclic substituent, including, but not limited to, substituents at the 2', 4', and/or 5' positions. In certain embodiments, the furanosyl sugar moiety is a ribosyl sugar moiety. In certain embodiments, one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for linearly non-bicyclic modified sugar moieties include, but are not limited to, alkoxy (e.g., methoxy), alkyl, and those described in Manoharan et al., WO 2015/106128. Examples of 5'-substituent groups suitable for non-bicyclic modified sugar moieties include, but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$. OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2'-modified sugar moieties are referred to as 2'-substituted nucleosides or 2'-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. In certain such embodiments, the furanose ring is a ribose ring. Examples of such 4' to 2' bridging sugar substituents include, but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O-2', wherein each R, R$_a$, and R$_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C($R_a$)($R_b$)]$_n$—, —[C($R_a$)($R_b$)]$_n$—O—, —C($R_a$)=C($R_b$)—, —C($R_a$)=N—, —C(=N$R_a$)—, —C(=O)—, —C(=S)—, —O—, —Si($R_a$)$_2$—, —S(=O)$_x$—, and —N($R_a$)—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Elayadi et al., *Curr. Opinion Invens. Drugs*. 2001, 2, 558-561; Braasch et al., *Chem. Biol.*, 2001, 8, 1-7; Orum et al., *Curr. Opinion Mol. Ther.* 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

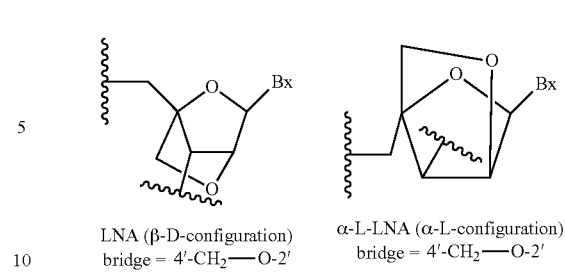

LNA (β-D-configuration)
bridge = 4'-$CH_2$—O-2'

α-L-LNA (α-L-configuration)
bridge = 4'-$CH_2$—O-2'

α-L-methyleneoxy (4'-$CH_2$—O—2') or α-L-LNA bicyclic nucleosides have been incorporated into oligonucleotides that showed antisense activity (Frieden et al., *Nucleic Acids Research*. 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include, but are not limited to, hexitol nucleic acid ("HNA"), anitol nucleic acid ("ANA"), manitol nucleic acid ("MNA") (see e.g., Leumann, CJ. *Bioorg. & Med. Chem.* 2002, 10, 841-854), fluoro HNA:

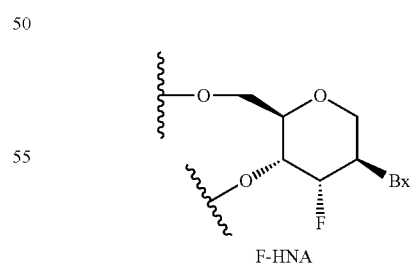

F-HNA ("F-HNA", see e.g., Swayze et al., U.S. Pat. No. 8,088,904; Swayze et al., U.S. Pat. No. 8,440,803; and Swayze et al., U.S. Pat. No. 9,005,906) F-HNA can also be referred to as a F-THP or 3'-fluoro tetrahydropyran, and nucleosides comprising additional modified THP compounds having the formula:

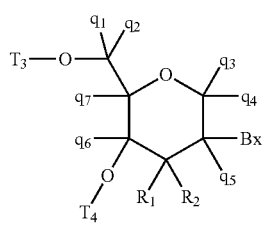

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506. As used here, the term "morpholino" means a sugar surrogate having the following structure:

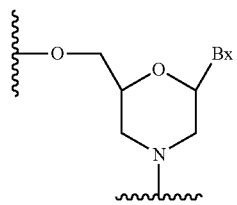

In certain embodiments, morpholinos may be modified, for example, by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include, but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., US2013/130378.

Many other bicyclic and tricyclic sugar and sugar surrogate ring systems are known in the art that can be used in modified nucleosides.

In certain embodiments, modified oligonucleotides comprise a 2'-OMe modified nucleoside in the gap of a cEt gapmer. In certain embodiments, the 2'-OMe modified nucleoside is at position 2 or 3 of the gap. In certain embodiments, the 2'-OMe modified nucleoside is at position 2 of the gap. In certain embodiments, modified oligonucleotides have a sugar motif kkkdmddddddddkkk, wherein each k represents a cEt nucleoside, each d represents a 2'-β-D-deoxyribosyl nucleoside, and each m represents a nucleoside comprising a 2'-OMe sugar moiety ("2'-OMe nucleoside").

In certain embodiments, modified oligonucleotides have a formula A-B—C, wherein A is a 5'-region, B is a central region, and C is a 3'-region. In certain embodiments, A and C each consist of 1-5 linked nucleosides and B consists of 7-11 linked nucleosides. In certain embodiments, A and C consist of 3 linked cEt nucleosides. In certain embodiments, the second nucleoside of the central region comprises a 2'-OMe modified sugar moiety, and each of the remaining central region nucleosides comprises a 2'-p-D-deoxyribosyl sugar moiety.

In certain embodiments, modified oligonucleotides comprise a neutral phosphonate linkage at one or more positions. In certain embodiments, modified oligonucleotides comprise a methoxypropyl phosphonate linkage at one or more positions. In certain embodiments, the sugar motif of a modified oligonucleotide is a gapmer, and the internucleoside linkage motif comprises at least one methoxypropyl phosphonate linkage in the gap. In certain embodiments, the methoxypropyl phosphonate linkage is between the second and third nucleosides in the gap. In certain embodiments, the methoxypropyl phosphonate linkage is between the third and fourth nucleosides in the gap.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleosides that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C≡C—CH₃) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly, 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one, and 9-(2-aminoethoxy)-1,3-diazaphenoxazine-2-one (G-clamp). Modified nucleobases may also include those in which the purine or pyrimidine base is replaced with other heterocycles, for example, 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases, as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Frochler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds targeted to a HSD17B13 nucleic acid comprise one or more modified nucleobases. In certain embodiments, the modified nucleobase is 5-methylcytosine. In certain embodiments, each cytosine is a 5-methylcytosine.

Modified Internucleoside Linkages

The naturally occurring internucleoside linkage of RNA and DNA is a Y to 5 phosphodiester linkage. In certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

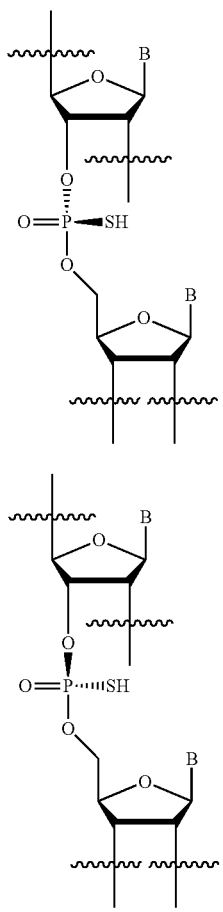

Unless otherwise indicated, chiral internucleoside linkages of modified oligonucleotides described herein can be stereorandom or in a particular stereochemical configuration.

In certain embodiments, compounds targeted to a HSD17B13 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include, but are not limited to, phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include, but are not limited to, methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include, but are not limited to, alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH$_2$—N(CH$_3$)—O—5'), amide-3 (3'-CH$_2$—C(=O)—N(H)-5'), amide-4 (3'-CH$_2$—N(H)—C(=O)-5'), formacetal (3'-O—CH$_2$—O—5'), methoxypropyl, and thioformacetal (3'-S—CH$_2$—O—5'). Further neutral internucleoside linkages include nonionic linkages comprising siloxane (dialkylsiloxane), carboxylate ester, carboxamide, sulfide, sulfonate ester and amides (See, for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments, the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and, if it does have a gapped nucleoside motif, the wing and gap lengths may or may not be the same.

In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosphonate linkages. In certain embodiments, oligonucleotides having a gapmer nucleoside motif comprise a linkage motif comprising all phosphorothioate linkages except for one or two methylphosphonate linkages. In certain embodiments, one methylphosphonate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments, it is desirable to decrease the number of phosphorothioate internucleoside linkages while retaining nuclease resistance. In certain embodiments, it is desirable to increase the number of phosphodiester internucleoside linkages while retaining nuclease resistance.

3. Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleosides comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include, but are not limited to, any of the sugar modifications discussed herein.

In certain embodiments, modified oligonucleotides comprise or consist of a region having a gapmer motif, which comprises two external regions or "wings" and a central or internal region or "gap". The three regions of a gapmer motif (the 5'-wing, the gap, and the 3'-wing) form a contiguous sequence of nucleosides, wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleosides having a sugar moiety that differs from the sugar moiety of one or more other nucleosides of the gap. In certain embodiments, the sugar motifs of the two wings are the same as one another (symmetric gapmer). In certain embodiments, the sugar motif of the 5-wing differs from the sugar motif of the 3-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiments, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments, the block is within 3 nucleosides of the 3'-end of the oligonucleotide. In certain embodiments, the block is at the 5'-end of the oligonucleotide. In certain embodiments, the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

4. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobases independent of the gapmer pattern of the sugar modifications. Furthermore, in certain instances, an oligonucleotide is described by an overall length or range and by lengths or length ranges of two or more regions (e.g., a regions of nucleosides having specified sugar modifications). In such circumstances, it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide will be 22, which exceeds the upper limit of the overall length of the modified oligonucleotide (20). Herein, if a description of an oligonucleotide is silent with respect to one or more parameters, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and, optionally, one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a pre-mRNA. In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., Bioorg. Med. Chem. Lett., 1994, 4, 1053-1060), a thioether, e.g., hexyl-S-tritylthiol (Manoharan et al., Ann. N. Y. Acad. Sci., 1992, 660, 306-309; Manoharan et al., Bioorg. Med. Chem. Lett., 1993, 3, 2765-2770), a thiocholesterol (Oberhauser et al., Nucl. Acids Res., 1992, 20, 533-538), an aliphatic chain, e.g., do-decan-diol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid a palmityl moiety (Mishra et al., Biochim. Biophys. Acta, 1995, 1264, 229-237), an octadecylamine or hexylamino-carbonyl-oxycholesterol moiety (Crooke et al., J. Pharmacol. Exp. Ther., 1996, 277, 923-937), a tocopherol group (Nishina et al., Molecular Therapy Nucleic Acids, 2015, 4, e220; and Nishina et al., Molecular Therapy, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, the conjugate linker is a single chemical bond (i.e., the conjugate moiety is attached directly to an oligonucleotide through a single bond). In certain compounds, a conjugate moiety is attached to an oligonucleotide via a more complex conjugate linker comprising one or more conjugate linker moieities, which are sub-units making up a conjugate linker. In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which an compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, a compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

3. Certain Cell-Targeting Conjugate Moieties

In certain embodiments, a conjugate group comprises a cell-targeting conjugate moiety. In certain embodiments, a conjugate group has the general formula:

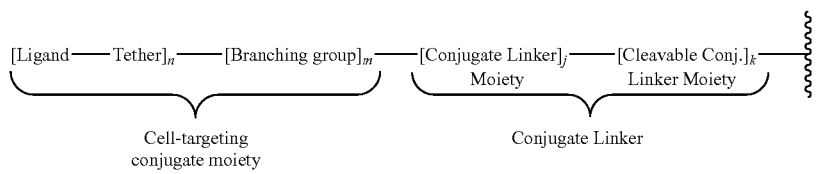

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

In certain embodiments, the cell-targeting moiety comprises a branching group comprising one or more groups selected from alkyl, amino, oxo, amide, disulfide, polyethylene glycol, ether, thioether and hydroxylamino groups. In certain embodiments, the branching group comprises a branched aliphatic group comprising groups selected from alkyl, amino, oxo, amide, disulfide, polyethylene glycol, ether, thioether and hydroxylamino groups. In certain such embodiments, the branched aliphatic group comprises groups selected from alkyl, amino, oxo, amide and ether groups. In certain such embodiments, the branched aliphatic group comprises groups selected from alkyl, amino and ether groups. In certain such embodiments, the branched aliphatic group comprises groups selected from alkyl and ether groups. In certain embodiments, the branching group comprises a mono or polycyclic ring system.

In certain embodiments, each tether of a cell-targeting moiety comprises one or more groups selected from alkyl, substituted alkyl, ether, thioether, disulfide, amino, oxo, amide, phosphodiester, and polyethylene glycol, in any combination. In certain embodiments, each tether is a linear aliphatic group comprising one or more groups selected from alkyl, ether, thioether, disulfide, amino, oxo, amide, and polyethylene glycol, in any combination. In certain embodiments, each tether is a linear aliphatic group comprising one or more groups selected from alkyl, phosphodiester, ether, amino, oxo, and amide, in any combination. In certain embodiments, each tether is a linear aliphatic group comprising one or more groups selected from alkyl, ether, amino, oxo, and amid, in any combination. In certain embodiments, each tether is a linear aliphatic group comprising one or more groups selected from alkyl, amino, and oxo, in any combination. In certain embodiments, each tether is a linear aliphatic group comprising one or more groups selected from alkyl and oxo, in any combination. In certain embodiments, each tether is a linear aliphatic group comprising one or more groups selected from alkyl and phosphodiester, in any combination. In certain embodiments, each tether comprises at least one phosphorus linking group or neutral linking group. In certain embodiments, each tether comprises a chain from about 6 to about 20 atoms in length. In certain embodiments, each tether comprises a chain from about 10 to about 18 atoms in length. In certain embodiments, each tether comprises about 10 atoms in chain length.

In certain embodiments, each ligand of a cell-targeting moiety has an affinity for at least one type of receptor on a target cell. In certain embodiments, each ligand has an affinity for at least one type of receptor on the surface of a mammalian liver cell. In certain embodiments, each ligand has an affinity for the hepatic asialoglycoprotein receptor (ASGP-R). In certain embodiments, each ligand is a carbohydrate. In certain embodiments, each ligand is, independently selected from galactose, N-acetyl galactoseamine (GalNAc), mannose, glucose, glucoseamine and fucose. In certain embodiments, each ligand is N-acetyl galactoseamine (GalNAc). In certain embodiments, the cell-targeting moiety comprises 3 GalNAc ligands. In certain embodiments, the cell-targeting moiety comprises 2 GalNAc ligands. In certain embodiments, the cell-targeting moiety comprises 1 GalNAc ligand.

In certain embodiments, each ligand of a cell-targeting moiety is a carbohydrate, carbohydrate derivative, modified carbohydrate, polysaccharide, modified polysaccharide, or polysaccharide derivative. In certain such embodiments, the conjugate group comprises a carbohydrate cluster (see, e.g., Maier et al., "Synthesis of Antisense Oligonucleotides Conjugated to a Multivalent Carbohydrate Cluster for Cellular Targeting," *Bioconjugate Chemistry*, 2003, 14, 18-29 or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, 47, 5798-5808). In certain such embodiments, each ligand is an amino sugar or a thio sugar. For example, amino sugars may be selected from any number of compounds known in the art, such as sialic acid, α-D-galactosamine, β-muramic acid, 2-deoxy-2-methylamino-L-glucopyranose, 4,6-dideoxy-4-formamido-2,3-di-O-methyl-D-mannopyranose, 2-deoxy-2-sulfoamino-D-glucopyranose and N-sulfo-D-glucosamine, and N-glycoloyl-α-neuraminic acid. For example, thio sugars may be selected from 5-Thio-β-D-glucopyranose, methyl 2,3,4-tri-O-acetyl-1-thio-6-O-trityl-α-D-glucopyranoside, 4-thio-β-D-galactopyranose, and ethyl 3,4,6,7-tetra-O-acetyl-2-deoxy-1,5-dithio-α-D-gluco-heptopyranoside.

In certain embodiments, conjugate groups comprise a cell-targeting moiety having the formula:

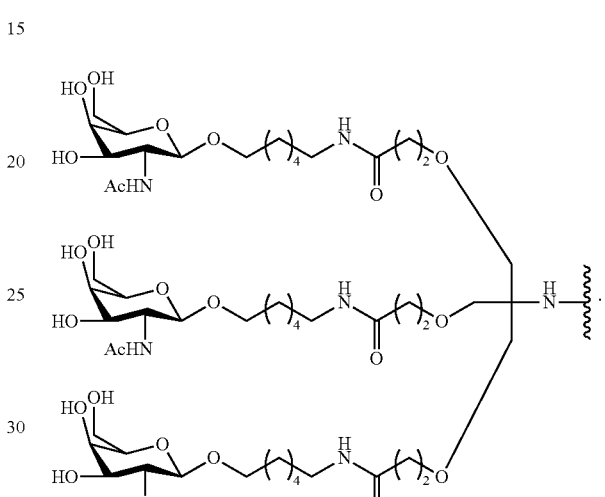

In certain embodiments, conjugate groups comprise a cell-targeting moiety having the formula:

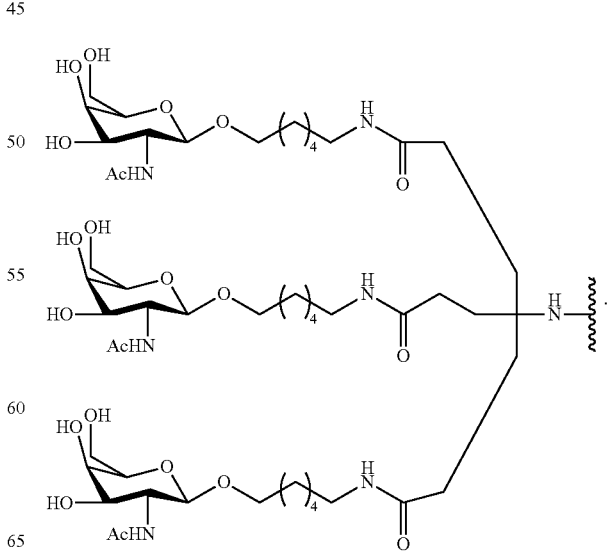

In certain embodiments, conjugate groups comprise a cell-targeting moiety having the formula:
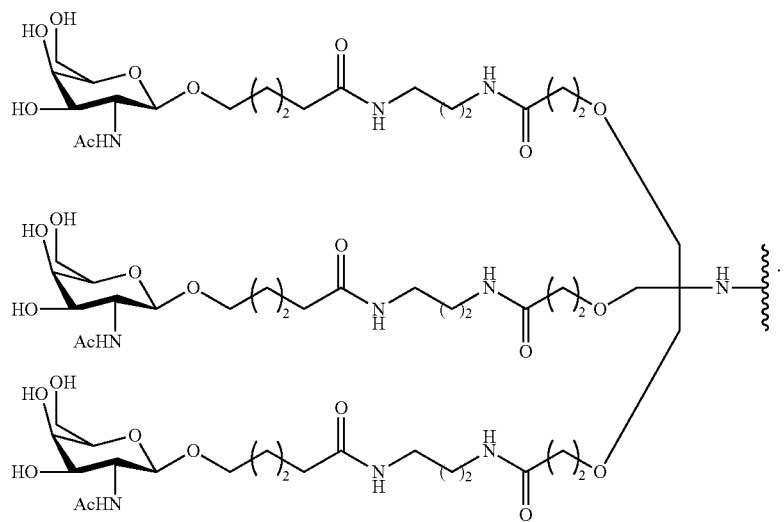
In certain embodiments, conjugate groups comprise a cell-targeting moiety having the formula:
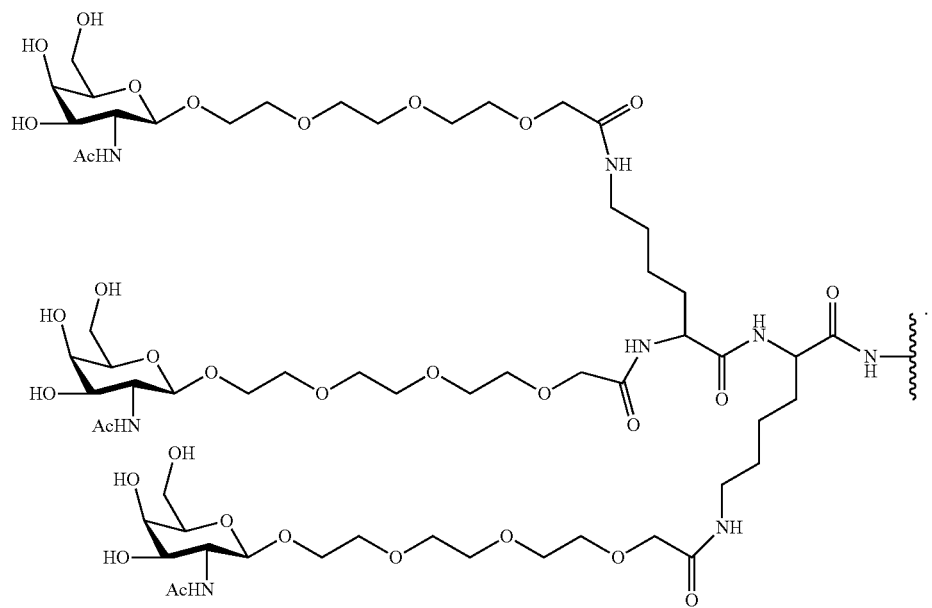

In certain embodiments, conjugate groups comprise a cell-targeting moiety having the formula:
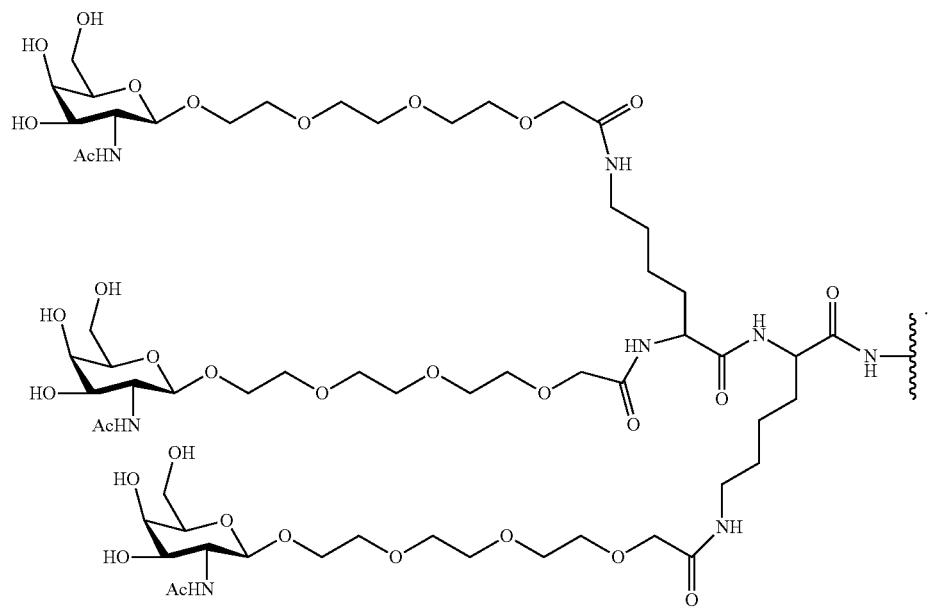
In certain embodiments, compounds comprise a conjugate group described herein as "LICA-1". LICA-1 has the formula:
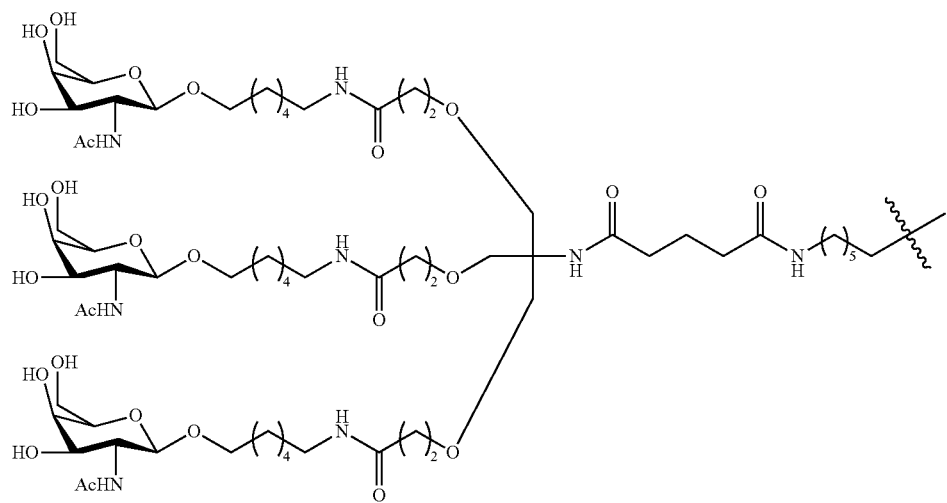

In certain embodiments, compounds described herein comprise LICA-1 and a cleavable moiety within the conjugate linker have the formula:

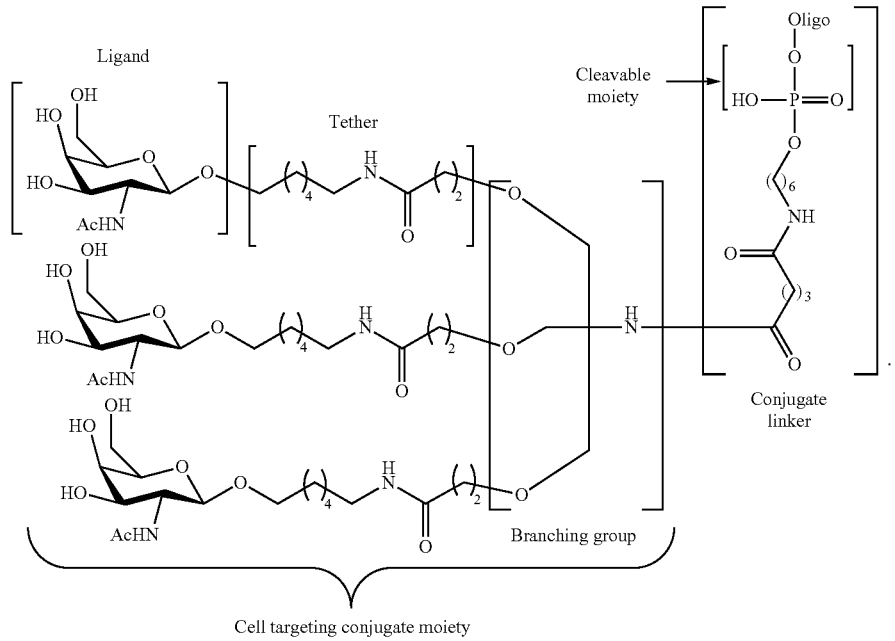

wherein oligo is an oligonucleotide.

Representative United States patents, United States patent application publications, international patent application publications, and other publications that teach the preparation of certain of the above noted conjugate groups, compounds comprising conjugate groups, tethers, conjugate linkers, branching groups, ligands, cleavable moieties as well as other modifications include without limitation, U.S. Pat. Nos. 5,994,517, 6,300,319, 6,660,720, 6,906,182, 7,262,177, 7,491,805, 8,106,022, 7,723,509, US 2006/0148740, US 2011/0123520, WO 2013/033230 and WO 2012/037254, Biessen et al., *J. Med. Chem.* 1995, 38, 1846-1852, Lee et al., *Bioorganic & Medicinal Chemistry* 2011, 19, 2494-2500, Rensen et al., *J. Biol. Chem.* 2001, 276, 37577-37584, Rensen et al., *J. Med. Chem.* 2004, 47, 5798-5808, Sliedregt et al., *J. Med. Chem.* 1999, 42, 609-618, and Valentijn et al., *Tetrahedron,* 1997, 53, 759-770.

In certain embodiments, modified oligonucleotides comprise a gapmer or fully modified sugar motif and a conjugate group comprising at least one, two, or three GalNAc ligands. In certain embodiments, compounds comprise a conjugate group found in any of the following references: Lee, *Carbohydr Res,* 1978, 67, 509-514; Connolly et al., *J Biol Chem,* 1982, 257, 939-945; Pavia et al., *Int J Pep Protein Res,* 1983, 22, 539-548; Lee et al., *Biochem,* 1984, 23, 4255-4261; Lee et al., *Glycoconjugate J,* 1987, 4, 317-328; Toyokuni et al., *Tetrahedron Lett,* 1990, 31, 2673-2676; Biessen et al., *J Med Chem,* 1995, 38, 1538-1546; Valentijn et al., *Tetrahedron,* 1997, 53, 759-770; Kim et al., *Tetrahedron Lett,* 1997, 38, 3487-3490; Lee et al., *Bioconjug Chem,* 1997, 8, 762-765; Kato et al., *Glycobiol,* 2001, 11, 821-829; Rensen et al., *J Biol Chem,* 2001, 276, 37577-37584; Lee et al., *Methods Enzymol,* 2003, 362, 38-43; Westerlind et al., *Glycoconj J,* 2004, 21, 227-241; Lee et al., *Bioorg Med Chem Lett,* 2006, 16(19), 5132-5135; Maierhofer et al., *Bioorg Med Chem,* 2007, 15, 7661-7676; Khorev et al., *Bioorg Med Chem,* 2008, 16, 5216-5231; Lee et al., *Bioorg Med Chem,* 2011, 19, 2494-2500; Kornilova et al., *Analyt Biochem,* 2012, 425, 43-46; Pujol et al., *Angew Chemie Int Ed Engl,* 2012, 51, 7445-7448; Biessen et al., *J Med Chem,* 1995, 38, 1846-1852; Sliedregt et al., *J Med Chem,* 1999, 42, 609-618; Rensen et al., *J Med Chem,* 2004, 47, 5798-5808; Rensen et al., *Arterioscler Thromb Vasc Biol,* 2006, 26, 169-175; van Rossenberg et al., *Gene Ther,* 2004, 11, 457-464; Sato et al., *J Am Chem Soc,* 2004, 126, 14013-14022; Lee et al., *J Org Chem,* 2012, 77, 7564-7571; Biessen et al., *FASEB J,* 2000, 14, 1784-1792; Rajur et al., *Bioconjug Chem,* 1997, 8, 935-940; Duff et al., *Methods Enzymol,* 2000, 313, 297-321; Maier et al., *Bioconjug Chem,* 2003, 14, 18-29; Jayaprakash et al., *Org Lett,* 2010, 12, 5410-5413; Manoharan, *Antisense Nucleic Acid Drug Dev,* 2002, 12, 103-128; Merwin et al., *Bioconjug Chem,* 1994, 5, 612-620; Tomiya et al., *Bioorg Med Chem,* 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/

0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132.

In certain embodiments, compounds are single-stranded. In certain embodiments, compounds are double-stranded.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compounds and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to HSD17B13 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to HSD17B13 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound.

In certain embodiments, the compounds or compositions further comprise a pharmaceutically acceptable carrier or diluent.

EXAMPLES

The Examples below describe the screening process to identify compounds targeted to HSD17B13.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to, those in the sequence listing, are intended to encompass nucleic acids containing any combination of natural or modified RNA and/or DNA, including, but not limited to, such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

Certain compounds described herein (e.g. modified oligonucleotides) have one or more asymmetric centers and thus give rise to enantiomers, diastereomers, and other stereoisomeric configurations that may be defined, in terms of absolute stereochemistry, as (R) or (S), as α or β, such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms. Likewise, all tautomeric forms of the compounds provided herein are included unless otherwise indicated. Unless otherwise indicated, oligomeric compounds and modified oligonucleotides described herein are intended to include corresponding salt forms.

Compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include, but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human HSD17B13 in HepaRG Cells by cEt Gapmers Modified oligonucleotides complementary to an HSD17B13 nucleic acid were synthesized and tested for their effect on HSD17B13 RNA levels in vitro. The modified oligonucleotides were tested in a series of experiments using the same culture conditions. The results for each separate experiment are presented in tables below.

The modified oligonucleotides were all 3-10-3 cEt gapmers (i.e. had a central gap segment often 2'-deoxynucleosides flanked on each side by wing segments each comprising three cEt modified nucleosides). The internucleoside linkages throughout each modified oligonucleotide were phosphorothioate (P=S) linkages. All cytosine nucleobases throughout each modified oligonucleotide were 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the Tables below, the modified oligonucleotide are complementary to either the human HSD17B13 mRNA, designated herein as SEQ ID NO: 1 (GENBANK Accession No. NM_178135.4) or to the human HSD17B13 genomic sequence, designated herein as SEQ ID NO: 2 (the complement of GENBANK Accession No. NC_000004.12 truncated from nucleotides 87301001 to 87326000) or to both. 'N/A' indicates that the modified oligonucleotide is not complementary to that particular target sequence with 100% complementarity.

Cultured HepaRG cells at a density of 20,000 cells per well were transfected using electroporation with 1,000 nM of modified oligonucleotide. After a treatment period of approximately 24 hours, RNA was isolated from the cells and HSD17B13 RNA levels were measured by quantitative real-time RTPCR. Human primer probe set RTS43553 (forward sequence AGACTACAGAAGTTCTTCCTGAAC, designated herein as SEQ ID NO: 5; reverse sequence CATCTCTGGCTGGAGCTTATT, designated herein as SEQ ID NO: 6; probe sequence TTT-GAAGCAGTGGTTGGCCACAAA, designated herein as SEQ ID NO: 7) was used to measure RNA levels. HSD17B13 RNA levels were normalized to total RNA content, as measured by RIBOGREEN®. Results are presented as percent inhibition of HSD17B13 relative to untreated control cells. As used herein, a value of '0' indicates that treatment with the modified oligonucleotide did not inhibit HSD17B13 mRNA levels. An asterisk (*) indicates that the modified oligonucleotide is complementary to the target transcript within the amplicon region of the primer probe set and so, the associated data is not reliable. In such instances, additional using alternate primer probe sets must be performed to accurately assess the potency and efficacy of such modified oligonucleotides.

TABLE 1

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245068 | 1 | 16 | 3095 | 3110 | GGAGGAGGTACTGTCT | 44 | 8 |
| 1245094 | 59 | 74 | 3153 | 3168 | GATGTTCATGGCTTTG | 81 | 9 |
| 1245120 | 111 | 126 | 3205 | 3220 | ACTCCAAGTAGGAGTA | 0 | 10 |
| 1245146 | 181 | 196 | 3275 | 3290 | GCTCCAGTAATGAGAA | 34 | 11 |
| 1245172 | 251 | 266 | 3345 | 3360 | ATCCCACAGAACCAAT | 34 | 12 |
| 1245198 | 299 | 314 | 7588 | 7603 | TAGTTTTCGGCACTCA | 35 | 13 |
| 1245224 | 359 | 374 | 7648 | 7663 | AGAGCGATAGATCTCT | 8 | 14 |
| 1245250 | 402 | 417 | 8796 | 8811 | CCACGATTGTTACATC | 42 | 15 |
| 1245276 | 432 | 447 | 8826 | 8841 | CGGCTGGATATACTGT | 35 | 16 |
| 1245302 | 473 | 488 | 8867 | 8882 | AAATGTCTTGGTAATC | 30 | 17 |
| 1245328 | 515 | 530 | 10401 | 10416 | AAGTGCTTTTGTGATC | 41 | 18 |
| 1245354 | 561 | 576 | 10447 | 10462 | CCACTGTGACGATGTG | 0 | 19 |
| 1245380 | 614 | 629 | N/A | N/A | GCTGGAACAATATGGG | 36 | 20 |
| 1245406 | 670 | 685 | 12088 | 12103 | CCCAAGGCCTGAAGTT | 61 | 21 |

TABLE 1-continued

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245432 | 759 | 774 | 15640 | 15655 | ATACAGGCCATAATCT | 0 | 22 |
| 1245458 | 790 | 805 | 15671 | 15686 | ATCAGACTTCTTACGA | 45 | 23 |
| 1245484 | 842 | 857 | 15723 | 15738 | ATTGATATACGATGGA | 31 | 24 |
| 1245510* | 907 | 922 | 20722 | 20737 | TTCTGCATACGATTTA | 83 | 25 |
| 1245536* | 973 | 988 | 20788 | 20803 | TCTGGCTGGAGCTTAT | 85 | 26 |
| 1245562 | 1014 | 1029 | 20829 | 20844 | CATTGATTCGAAACTA | 40 | 27 |
| 1245588 | 1088 | 1103 | 20903 | 20918 | TTGACTGCTGCTAGTG | 30 | 28 |
| 1245614 | 1260 | 1275 | 21075 | 21090 | GGTAGCTTTTGTCCAC | 66 | 29 |
| 1245640 | 1314 | 1329 | 21129 | 21144 | CAGTCTTAAACCTTCC | 70 | 30 |
| 1245666 | 1341 | 1356 | 21156 | 21171 | TGGCTACAGATTGGAA | 55 | 31 |
| 1245692 | 1385 | 1400 | 21200 | 21215 | TTAGCTGTGCACTCAT | 61 | 32 |
| 1245718 | 1423 | 1438 | 21238 | 21253 | CCAGGTTGAGATAAAG | 49 | 33 |
| 1245744 | 1499 | 1514 | 21314 | 21329 | AGAGTTGCACCGTTTT | 76 | 34 |
| 1245770 | 1558 | 1573 | 21373 | 21388 | CACTTTTGGTGGACTT | 21 | 35 |
| 1245796 | 1617 | 1632 | 21432 | 21447 | CGGTCACCTTTCATAA | 69 | 36 |
| 1245822 | 1710 | 1725 | 21525 | 21540 | ATCTCTGGGACCAAGG | 72 | 37 |
| 1245841 | 1765 | 1780 | 21580 | 21595 | GTACAGTTCCTTTTCC | 55 | 38 |
| 1245848 | 1772 | 1787 | 21587 | 21602 | ATAGCCAGTACAGTTC | 65 | 39 |
| 1245874 | 2177 | 2192 | 21992 | 22007 | GGAGTCGGATTATTTT | 41 | 40 |
| 1245900 | 2244 | 2259 | 22059 | 22074 | GTCCATGCAAAAGCAT | 62 | 41 |
| 1245926 | N/A | N/A | 3405 | 3420 | AATACATATCTTACTC | 37 | 42 |
| 1245952 | N/A | N/A | 3552 | 3567 | GTCATAAAAATCGCTG | 72 | 43 |
| 1245978 | N/A | N/A | 3948 | 3963 | GAAAAGCCTGACTCAC | 48 | 44 |
| 1246004 | N/A | N/A | 4517 | 4532 | CATCAAGCCCTTTTCA | 23 | 45 |
| 1246030 | N/A | N/A | 5078 | 5093 | CTAAAGGAGATCTGAG | 47 | 46 |
| 1246056 | N/A | N/A | 5222 | 5237 | TAGCTTAAACTCCAAT | 60 | 47 |
| 1246065 | N/A | N/A | 5659 | 5674 | ATAAGTTACCAGAGCA | 87 | 48 |
| 1246082 | N/A | N/A | 5817 | 5832 | CTCAAAGTCAGTATCC | 70 | 49 |
| 1246108 | N/A | N/A | 5989 | 6004 | GGCAAGGATACCTGAA | 67 | 50 |
| 1246134 | N/A | N/A | 6233 | 6248 | CTCATTTATGTACCAA | 87 | 51 |
| 1246160 | N/A | N/A | 6474 | 6489 | TATGTAATAGGCAGTA | 62 | 52 |
| 1246186 | N/A | N/A | 7482 | 7497 | GACAATTAACATTCGG | 69 | 53 |
| 1246212 | N/A | N/A | 7951 | 7966 | CTAGGAAGTGATCCAT | 66 | 54 |
| 1246238 | N/A | N/A | 8243 | 8258 | CTAATAACTACATGAC | 18 | 55 |
| 1246264 | N/A | N/A | 8694 | 8709 | TCCAAAGATGAGAGTC | 17 | 56 |
| 1246290 | N/A | N/A | 9002 | 9017 | GCAAAGATCTGGCCAG | 22 | 57 |

TABLE 1-continued

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246316 | N/A | N/A | 9348 | 9363 | TCCAAAAGTGTCCTCG | 31 | 58 |
| 1246342 | N/A | N/A | 9518 | 9533 | CTACACTAATATTGAG | 20 | 59 |
| 1246368 | N/A | N/A | 9715 | 9730 | AGTGAACATACATTGT | 48 | 60 |
| 1246394 | N/A | N/A | 9981 | 9996 | ATTAAGACAGTTGAGT | 34 | 61 |
| 1246420 | N/A | N/A | 10211 | 10226 | ATTTATTGGTATGGTA | 46 | 62 |
| 1246446 | N/A | N/A | 10730 | 10745 | CTGTAATTGGCTCTTG | 28 | 63 |
| 1246472 | N/A | N/A | 11261 | 11276 | TCTTATCTTGGGCACC | 44 | 64 |
| 1246498 | N/A | N/A | 11742 | 11757 | TCCATTGAATCTTCAA | 57 | 65 |
| 1246524 | N/A | N/A | 11985 | 12000 | GAAACCAATCCTCAGC | 3 | 66 |
| 1246550 | N/A | N/A | 12421 | 12436 | TGGTAACGGTGATCAA | 74 | 67 |
| 1246576 | N/A | N/A | 12624 | 12639 | TTAAGCAGATGGCTTA | 0 | 68 |
| 1246602 | N/A | N/A | 12761 | 12776 | ACAGAGAATTGTTTAG | 39 | 69 |
| 1246628 | N/A | N/A | 13605 | 13620 | AGACAATACAGGATAG | 15 | 70 |
| 1246654 | N/A | N/A | 13862 | 13877 | CCTTAGGAAAGCTCAT | 29 | 71 |
| 1246680 | N/A | N/A | 14041 | 14056 | ATCAATGCCTTAGCCC | 38 | 72 |
| 1246706 | N/A | N/A | 14199 | 14214 | TATTATGTGATTGAGT | 86 | 73 |
| 1246732 | N/A | N/A | 14399 | 14414 | ATTCATAAACATAGGC | 36 | 74 |
| 1246758 | N/A | N/A | 14730 | 14745 | ACTCTAAATACCCTTG | 16 | 75 |
| 1246784 | N/A | N/A | 15316 | 15331 | GGATTAATCATGGGAC | 44 | 76 |
| 1246810 | N/A | N/A | 15405 | 15420 | TCATAGCTCACTTAGT | 0 | 77 |
| 1246836 | N/A | N/A | 15775 | 15790 | TTTAGTATTTGGGTGT | 21 | 78 |
| 1246862 | N/A | N/A | 16407 | 16422 | CAATTGCTCTATAGAT | 15 | 79 |
| 1246888 | N/A | N/A | 17767 | 17782 | AGCATATTCATTTGGC | 61 | 80 |
| 1246914 | N/A | N/A | 18033 | 18048 | AGTTTATATGGATTTG | 67 | 81 |
| 1246940 | N/A | N/A | 18816 | 18831 | CTAGTAATTGCATCTG | 57 | 82 |
| 1246966 | N/A | N/A | 19445 | 19460 | CTGGGATAGTGGAGGA | 21 | 83 |
| 1246992 | N/A | N/A | 19686 | 19701 | GCTAAAAGCTCACCAA | 26 | 84 |
| 1247018 | N/A | N/A | 19902 | 19917 | GATACCCAGGTTGCTT | 53 | 85 |
| 1247044 | N/A | N/A | 20186 | 20201 | ATTAGAAGTCAGCCCA | 42 | 86 |
| 1247070 | N/A | N/A | 20401 | 20416 | GCTATAGTAATTGCTA | 33 | 87 |

TABLE 2

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245069 | 2 | 17 | 3096 | 3111 | GGGAGGAGGTACTGTC | 35 | 88 |
| 1245095 | 61 | 76 | 3155 | 3170 | ATGATGTTCATGGCTT | 72 | 89 |
| 1245121 | 112 | 127 | 3206 | 3221 | GACTCCAAGTAGGAGT | 0 | 90 |
| 1245147 | 182 | 197 | 3276 | 3291 | AGCTCCAGTAATGAGA | 26 | 91 |
| 1245173 | 263 | 278 | N/A | N/A | GCGCTTATTAATATCC | 3 | 92 |
| 1245199 | 300 | 315 | 7589 | 7604 | CTAGTTTTCGGCACTC | 33 | 93 |
| 1245225 | 360 | 375 | 7649 | 7664 | GAGAGCGATAGATCTC | 1 | 94 |
| 1245251 | 403 | 418 | 8797 | 8812 | ACCACGATTGTTACAT | 34 | 95 |
| 1245277 | 433 | 448 | 8827 | 8842 | TCGGCTGGATATACTG | 23 | 96 |
| 1245303 | 476 | 491 | 8870 | 8885 | CTCAAATGTCTTGGTA | 29 | 97 |
| 1245329 | 516 | 531 | 10402 | 10417 | GAAGTGCTTTTGTGAT | 34 | 98 |
| 1245355 | 562 | 577 | 10448 | 10463 | GCCACTGTGACGATGT | 9 | 99 |
| 1245381 | 615 | 630 | N/A | N/A | TGCTGGAACAATATGG | 36 | 100 |
| 1245407 | 671 | 686 | 12089 | 12104 | TCCCAAGGCCTGAAGT | 43 | 101 |
| 1245433 | 760 | 775 | 15641 | 15656 | AATACAGGCCATAATC | 16 | 102 |
| 1245459 | 791 | 806 | 15672 | 15687 | TATCAGACTTCTTACG | 59 | 103 |
| 1245485 | 843 | 858 | 15724 | 15739 | TATTGATATACGATGG | 16 | 104 |
| 1245511* | 908 | 923 | 20723 | 20738 | ATTCTGCATACGATTT | 89 | 105 |
| 1245537* | 974 | 989 | 20789 | 20804 | CTCTGGCTGGAGCTTA | 86 | 106 |
| 1245563 | 1015 | 1030 | 20830 | 20845 | GCATTGATTCGAAACT | 66 | 107 |
| 1245589 | 1089 | 1104 | 20904 | 20919 | TTTGACTGCTGCTAGT | 21 | 108 |
| 1245615 | 1261 | 1276 | 21076 | 21091 | AGGTAGCTTTTGTCCA | 56 | 109 |
| 1245641 | 1315 | 1330 | 21130 | 21145 | ACAGTCTTAAACCTTC | 76 | 110 |
| 1245667 | 1342 | 1357 | 21157 | 21172 | ATGGCTACAGATTGGA | 72 | 111 |
| 1245693 | 1386 | 1401 | 21201 | 21216 | CTTAGCTGTGCACTCA | 60 | 112 |
| 1245719 | 1425 | 1440 | 21240 | 21255 | GTCCAGGTTGAGATAA | 60 | 113 |
| 1245745 | 1500 | 1515 | 21315 | 21330 | TAGAGTTGCACCGTTT | 58 | 114 |
| 1245771 | 1559 | 1574 | 21374 | 21389 | CCACTTTTGGTGGACT | 17 | 115 |
| 1245797 | 1618 | 1633 | 21433 | 21448 | TCGGTCACCTTTCATA | 64 | 116 |
| 1245823 | 1711 | 1726 | 21526 | 21541 | CATCTCTGGGACCAAG | 51 | 117 |
| 1245841 | 1765 | 1780 | 21580 | 21595 | GTACAGTTCCTTTTCC | 46 | 38 |
| 1245849 | 1773 | 1788 | 21588 | 21603 | AATAGCCAGTACAGTT | 46 | 118 |
| 1245875 | 2178 | 2193 | 21993 | 22008 | GGGAGTCGGATTATTT | 33 | 119 |
| 1245901 | 2245 | 2260 | 22060 | 22075 | AGTCCATGCAAAAGCA | 77 | 120 |
| 1245927 | N/A | N/A | 3433 | 3448 | AGTAGATGGTAAGTCA | 90 | 121 |
| 1245953 | N/A | N/A | 3553 | 3568 | TGTCATAAAAATCGCT | 57 | 122 |

TABLE 2-continued

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245979 | N/A | N/A | 3962 | 3977 | TACTAATGTCCAAGGA | 77 | 123 |
| 1246005 | N/A | N/A | 4529 | 4544 | AAGGTTAGATTTCATC | 80 | 124 |
| 1246031 | N/A | N/A | 5079 | 5094 | CCTAAAGGAGATCTGA | 48 | 125 |
| 1246057 | N/A | N/A | 5225 | 5240 | CTTTAGCTTAAACTCC | 69 | 126 |
| 1246065 | N/A | N/A | 5659 | 5674 | ATAAGTTACCAGAGCA | 84 | 48 |
| 1246083 | N/A | N/A | 5833 | 5848 | GATGTTAGGACCCAGT | 64 | 127 |
| 1246109 | N/A | N/A | 5990 | 6005 | AGGCAAGGATACCTGA | 42 | 128 |
| 1246135 | N/A | N/A | 6298 | 6313 | GGAGATATAACATTAC | 70 | 129 |
| 1246161 | N/A | N/A | 6475 | 6490 | CTATGTAATAGGCAGT | 73 | 130 |
| 1246187 | N/A | N/A | 7483 | 7498 | AGACAATTAACATTCG | 62 | 131 |
| 1246213 | N/A | N/A | 7952 | 7967 | ACTAGGAAGTGATCCA | 58 | 132 |
| 1246239 | N/A | N/A | 8244 | 8259 | CCTAATAACTACATGA | 3 | 133 |
| 1246265 | N/A | N/A | 8695 | 8710 | ATCCAAAGATGAGAGT | 5 | 134 |
| 1246291 | N/A | N/A | 9003 | 9018 | GGCAAAGATCTGGCCA | 10 | 135 |
| 1246317 | N/A | N/A | 9349 | 9364 | GTCCAAAAGTGTCCTC | 35 | 136 |
| 1246343 | N/A | N/A | 9526 | 9541 | CCTAGATTCTACACTA | 14 | 137 |
| 1246369 | N/A | N/A | 9718 | 9733 | GATAGTGAACATACAT | 54 | 138 |
| 1246395 | N/A | N/A | 9983 | 9998 | GTATTAAGACAGTTGA | 45 | 139 |
| 1246421 | N/A | N/A | 10212 | 10227 | AATTTATTGGTATGGT | 30 | 140 |
| 1246447 | N/A | N/A | 10831 | 10846 | GTAAACGACTCTGTAA | 8 | 141 |
| 1246473 | N/A | N/A | 11308 | 11323 | GCACAAGCACACTGTA | 7 | 142 |
| 1246499 | N/A | N/A | 11758 | 11773 | CTACATGTAAGGTTTT | 11 | 143 |
| 1246525 | N/A | N/A | 12000 | 12015 | TAGCTAAGGGAGAGTG | 9 | 144 |
| 1246551 | N/A | N/A | 12429 | 12444 | AGACAGGGTGGTAACG | 51 | 145 |
| 1246577 | N/A | N/A | 12625 | 12640 | GTTAAGCAGATGGCTT | 41 | 146 |
| 1246603 | N/A | N/A | 12765 | 12780 | CTCAACAGAGAATTGT | 29 | 147 |
| 1246629 | N/A | N/A | 13612 | 13627 | GCTTTGAAGACAATAC | 42 | 148 |
| 1246655 | N/A | N/A | 13863 | 13878 | CCCTTAGGAAAGCTCA | 37 | 149 |
| 1246681 | N/A | N/A | 14042 | 14057 | TATCAATGCCTTAGCC | 15 | 150 |
| 1246707 | N/A | N/A | 14200 | 14215 | TTATTATGTGATTGAG | 23 | 151 |
| 1246733 | N/A | N/A | 14432 | 14447 | ACTGAAGGCTGTGTAC | 14 | 152 |
| 1246759 | N/A | N/A | 14731 | 14746 | AACTCTAAATACCCTT | 28 | 153 |
| 1246785 | N/A | N/A | 15317 | 15332 | AGGATTAATCATGGGA | 37 | 154 |
| 1246811 | N/A | N/A | 15407 | 15422 | TTTCATAGCTCACTTA | 16 | 155 |
| 1246837 | N/A | N/A | 15787 | 15802 | CTCTATTGGTGTTTTA | 32 | 156 |
| 1246863 | N/A | N/A | 16416 | 16431 | AATACTCCCCAATTGC | 0 | 157 |

TABLE 2-continued

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246889 | N/A | N/A | 17780 | 17795 | AGAAGATATTATCAGC | 64 | 158 |
| 1246915 | N/A | N/A | 18087 | 18102 | CACCAATGCAGTTTGT | 42 | 159 |
| 1246941 | N/A | N/A | 18817 | 18832 | GCTAGTAATTGCATCT | 47 | 160 |
| 1246967 | N/A | N/A | 19474 | 19489 | GCTATAACTGGAAGGA | 58 | 161 |
| 1246993 | N/A | N/A | 19687 | 19702 | TGCTAAAAGCTCACCA | 49 | 162 |
| 1247019 | N/A | N/A | 19906 | 19921 | TTAAGATACCCAGGTT | 37 | 163 |
| 1247045 | N/A | N/A | 20187 | 20202 | TATTAGAAGTCAGCCC | 27 | 164 |
| 1247071 | N/A | N/A | 20402 | 20417 | GGCTATAGTAATTGCT | 13 | 165 |

TABLE 3

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245070 | 5 | 20 | 3099 | 3114 | CTAGGGAGGAGGTACT | 29 | 166 |
| 1245096 | 62 | 77 | 3156 | 3171 | GATGATGTTCATGGCT | 86 | 167 |
| 1245122 | 113 | 128 | 3207 | 3222 | CGACTCCAAGTAGGAG | 10 | 168 |
| 1245148 | 200 | 215 | 3294 | 3309 | CCTGCCTATTCCATGC | 24 | 169 |
| 1245174 | 264 | 279 | N/A | N/A | CGCGCTTATTAATATC | 6 | 170 |
| 1245200 | 301 | 316 | 7590 | 7605 | CCTAGTTTTCGGCACT | 62 | 171 |
| 1245226 | 361 | 376 | 7650 | 7665 | AGAGAGCGATAGATCT | 15 | 172 |
| 1245252 | 404 | 419 | 8798 | 8813 | CACCACGATTGTTACA | 36 | 173 |
| 1245278 | 434 | 449 | 8828 | 8843 | ATCGGCTGGATATACT | 10 | 174 |
| 1245304 | 477 | 492 | 8871 | 8886 | CCTCAAATGTCTTGGT | 6 | 175 |
| 1245330 | 524 | 539 | 10410 | 10425 | CGATGGAAGAAGTGCT | 3 | 176 |
| 1245356 | 563 | 578 | 10449 | 10464 | AGCCACTGTGACGATG | 10 | 177 |
| 1245382 | 616 | 631 | N/A | N/A | TTGCTGGAACAATATG | 20 | 178 |
| 1245408 | 688 | 703 | 12106 | 12121 | GTTTTGATACCAGTTT | 67 | 179 |
| 1245434 | 761 | 776 | 15642 | 15657 | CAATACAGGCCATAAT | 0 | 180 |
| 1245460 | 792 | 807 | 15673 | 15688 | CTATCAGACTTCTTAC | 39 | 181 |
| 1245486 | 844 | 859 | 15725 | 15740 | ATATTGATATACGATG | 0 | 182 |
| 1245512* | 909 | 924 | 20724 | 20739 | TATTCTGCATACGATT | 81 | 183 |
| 1245538* | 975 | 990 | 20790 | 20805 | TCTCTGGCTGGAGCTT | 90 | 184 |
| 1245564 | 1016 | 1031 | 20831 | 20846 | AGCATTGATTCGAAAC | 70 | 185 |
| 1245590 | 1090 | 1105 | 20905 | 20920 | GTTTGACTGCTGCTAG | 58 | 186 |
| 1245616 | 1262 | 1277 | 21077 | 21092 | GAGGTAGCTTTTGTCC | 59 | 187 |

TABLE 3-continued

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245642 | 1316 | 1331 | 21131 | 21146 | AACAGTCTTAAACCTT | 82 | 188 |
| 1245668 | 1343 | 1358 | 21158 | 21173 | CATGGCTACAGATTGG | 54 | 189 |
| 1245694 | 1387 | 1402 | 21202 | 21217 | TCTTAGCTGTGCACTC | 69 | 190 |
| 1245720 | 1426 | 1441 | 21241 | 21256 | TGTCCAGGTTGAGATA | 48 | 191 |
| 1245746 | 1501 | 1516 | 21316 | 21331 | ATAGAGTTGCACCGTT | 57 | 192 |
| 1245772 | 1560 | 1575 | 21375 | 21390 | TCCACTTTTGGTGGAC | 16 | 193 |
| 1245798 | 1619 | 1634 | 21434 | 21449 | GTCGGTCACCTTTCAT | 85 | 194 |
| 1245824 | 1712 | 1727 | 21527 | 21542 | ACATCTCTGGGACCAA | 78 | 195 |
| 1245841 | 1765 | 1780 | 21580 | 21595 | GTACAGTTCCTTTTCC | 64 | 38 |
| 1245850 | 1774 | 1789 | 21589 | 21604 | TAATAGCCAGTACAGT | 64 | 196 |
| 1245876 | 2179 | 2194 | 21994 | 22009 | TGGGAGTCGGATTATT | 44 | 197 |
| 1245902 | 2246 | 2261 | 22061 | 22076 | TAGTCCATGCAAAAGC | 66 | 198 |
| 1245928 | N/A | N/A | 3434 | 3449 | AAGTAGATGGTAAGTC | 85 | 199 |
| 1245954 | N/A | N/A | 3554 | 3569 | ATGTCATAAAAATCGC | 53 | 200 |
| 1245980 | N/A | N/A | 3963 | 3978 | ATACTAATGTCCAAGG | 89 | 201 |
| 1246006 | N/A | N/A | 4535 | 4550 | GATTTGAAGGTTAGAT | 47 | 202 |
| 1246032 | N/A | N/A | 5080 | 5095 | GCCTAAAGGAGATCTG | 67 | 203 |
| 1246058 | N/A | N/A | 5239 | 5254 | TAGCAAAACACTTGCT | 21 | 204 |
| 1246065 | N/A | N/A | 5659 | 5674 | ATAAGTTACCAGAGCA | 87 | 48 |
| 1246084 | N/A | N/A | 5834 | 5849 | GGATGTTAGGACCCAG | 81 | 205 |
| 1246110 | N/A | N/A | 6035 | 6050 | ATACTTTTCCGTCTCA | 90 | 206 |
| 1246136 | N/A | N/A | 6303 | 6318 | CTCTAGGAGATATAAC | 49 | 207 |
| 1246162 | N/A | N/A | 6476 | 6491 | ACTATGTAATAGGCAG | 85 | 208 |
| 1246188 | N/A | N/A | 7681 | 7696 | AAATTTGTGAACCTGC | 26 | 209 |
| 1246214 | N/A | N/A | 7953 | 7968 | AACTAGGAAGTGATCC | 58 | 210 |
| 1246240 | N/A | N/A | 8245 | 8260 | ACCTAATAACTACATG | 0 | 211 |
| 1246266 | N/A | N/A | 8703 | 8718 | CCAATATAATCCAAAG | 28 | 212 |
| 1246292 | N/A | N/A | 9006 | 9021 | TAAGGCAAAGATCTGG | 46 | 213 |
| 1246318 | N/A | N/A | 9350 | 9365 | CGTCCAAAAGTGTCCT | 53 | 214 |
| 1246344 | N/A | N/A | 9527 | 9542 | CCCTAGATTCTACACT | 22 | 215 |
| 1246370 | N/A | N/A | 9719 | 9734 | GGATAGTGAACATACA | 62 | 216 |
| 1246396 | N/A | N/A | 9984 | 9999 | TGTATTAAGACAGTTG | 34 | 217 |
| 1246422 | N/A | N/A | 10335 | 10350 | CCAAATCAGGTAGTTT | 13 | 218 |
| 1246448 | N/A | N/A | 10832 | 10847 | AGTAAACGACTCTGTA | 33 | 219 |
| 1246474 | N/A | N/A | 11385 | 11400 | TTTTAGTCAGGTAGAG | 3 | 220 |
| 1246500 | N/A | N/A | 11761 | 11776 | ATCCTACATGTAAGGT | 24 | 221 |

TABLE 3-continued

Inhibition of HSD17B13 RNA by 3-10-3 cEt gapmers targeting SEQ ID NO: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246526 | N/A | N/A | 12002 | 12017 | GTTAGCTAAGGGAGAG | 18 | 222 |
| 1246552 | N/A | N/A | 12433 | 12448 | TTAAAGACAGGGTGGT | 21 | 223 |
| 1246578 | N/A | N/A | 12626 | 12641 | TGTTAAGCAGATGGCT | 39 | 224 |
| 1246604 | N/A | N/A | 12777 | 12792 | AATGAGGCGGCACTCA | 20 | 225 |
| 1246630 | N/A | N/A | 13639 | 13654 | TGACAATGTGCAGCTC | 64 | 226 |
| 1246656 | N/A | N/A | 13864 | 13879 | ACCCTTAGGAAAGCTC | 52 | 227 |
| 1246682 | N/A | N/A | 14043 | 14058 | ATATCAATGCCTTAGC | 32 | 228 |
| 1246708 | N/A | N/A | 14202 | 14217 | GATTATTATGTGATTG | 39 | 229 |
| 1246734 | N/A | N/A | 14435 | 14450 | TATACTGAAGGCTGTG | 44 | 230 |
| 1246760 | N/A | N/A | 14800 | 14815 | GAATTGCTCACCCTTT | 24 | 231 |
| 1246786 | N/A | N/A | 15318 | 15333 | TAGGATTAATCATGGG | 47 | 232 |
| 1246812 | N/A | N/A | 15418 | 15433 | CAGTAGGTGTGTTTCA | 47 | 233 |
| 1246838 | N/A | N/A | 15793 | 15808 | AAAAAGCTCTATTGGT | 0 | 234 |
| 1246864 | N/A | N/A | 16424 | 16439 | GATATGTCAATACTCC | 59 | 235 |
| 1246890 | N/A | N/A | 17857 | 17872 | CATTTGAAGTCTATAC | 21 | 236 |
| 1246916 | N/A | N/A | 18091 | 18106 | GATACACCAATGCAGT | 73 | 237 |
| 1246942 | N/A | N/A | 18818 | 18833 | TGCTAGTAATTGCATC | 17 | 238 |
| 1246968 | N/A | N/A | 19475 | 19490 | GGCTATAACTGGAAGG | 52 | 239 |
| 1246994 | N/A | N/A | 19688 | 19703 | ATGCTAAAAGCTCACC | 50 | 240 |
| 1247020 | N/A | N/A | 19907 | 19922 | CTTAAGATACCCAGGT | 36 | 241 |
| 1247046 | N/A | N/A | 20188 | 20203 | TTATTAGAAGTCAGCC | 36 | 242 |
| 1247072 | N/A | N/A | 20403 | 20418 | TGGCTATAGTAATTGC | 34 | 243 |

TABLE 4

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245071 | 6 | 21 | 3100 | 3115 | CCTAGGGAGGAGGTAC | 34 | 244 |
| 1245097 | 63 | 78 | 3157 | 3172 | GGATGATGTTCATGGC | 82 | 245 |
| 1245123 | 114 | 129 | 3208 | 3223 | ACGACTCCAAGTAGGA | 24 | 246 |
| 1245149 | 202 | 217 | 3296 | 3311 | TGCCTGCCTATTCCAT | 40 | 247 |
| 1245175 | 265 | 280 | N/A | N/A | CCGCGCTTATTAATAT | 21 | 248 |
| 1245201 | 302 | 317 | 7591 | 7606 | GCCTAGTTTTCGGCAC | 12 | 249 |
| 1245227 | 362 | 377 | 7651 | 7666 | TAGAGAGCGATAGATC | 22 | 250 |

TABLE 4-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245253 | 405 | 420 | 8799 | 8814 | TCACCACGATTGTTAC | 34 | 251 |
| 1245279 | 435 | 450 | 8829 | 8844 | GATCGGCTGGATATAC | 7 | 252 |
| 1245305 | 478 | 493 | 8872 | 8887 | ACCTCAAATGTCTTGG | 17 | 253 |
| 1245331 | 525 | 540 | 10411 | 10426 | TCGATGGAAGAAGTGC | 34 | 254 |
| 1245357 | 566 | 581 | 10452 | 10467 | TGAAGCCACTGTGACG | 49 | 255 |
| 1245383 | 623 | 638 | 12041 | 12056 | GGCAAATTTGCTGGAA | 54 | 256 |
| 1245409 | 689 | 704 | 12107 | 12122 | GGTTTTGATACCAGTT | 58 | 257 |
| 1245435 | 762 | 777 | 15643 | 15658 | CCAATACAGGCCATAA | 38 | 258 |
| 1245461 | 793 | 808 | 15674 | 15689 | TCTATCAGACTTCTTA | 49 | 259 |
| 1245487 | 845 | 860 | 15726 | 15741 | GATATTGATATACGAT | 2 | 260 |
| 1245513* | 910 | 925 | 20725 | 20740 | ATATTCTGCATACGAT | 36 | 261 |
| 1245539* | 977 | 992 | 20792 | 20807 | CATCTCTGGCTGGAGC | 79 | 262 |
| 1245565 | 1017 | 1032 | 20832 | 20847 | CAGCATTGATTCGAAA | 69 | 263 |
| 1245591 | 1091 | 1106 | 20906 | 20921 | CGTTTGACTGCTGCTA | 58 | 264 |
| 1245617 | 1263 | 1278 | 21078 | 21093 | GGAGGTAGCTTTTGTC | 43 | 265 |
| 1245643 | 1317 | 1332 | 21132 | 21147 | GAACAGTCTTAAACCT | 64 | 266 |
| 1245669 | 1344 | 1359 | 21159 | 21174 | GCATGGCTACAGATTG | 56 | 267 |
| 1245695 | 1388 | 1403 | 21203 | 21218 | CTCTTAGCTGTGCACT | 53 | 268 |
| 1245721 | 1427 | 1442 | 21242 | 21257 | ATGTCCAGGTTGAGAT | 55 | 269 |
| 1245747 | 1502 | 1517 | 21317 | 21332 | AATAGAGTTGCACCGT | 48 | 270 |
| 1245773 | 1561 | 1576 | 21376 | 21391 | GTCCACTTTTGGTGGA | 14 | 271 |
| 1245799 | 1620 | 1635 | 21435 | 21450 | AGTCGGTCACCTTTCA | 66 | 272 |
| 1245825 | 1713 | 1728 | 21528 | 21543 | AACATCTCTGGGACCA | 74 | 273 |
| 1245851 | 1775 | 1790 | 21590 | 21605 | GTAATAGCCAGTACAG | 77 | 274 |
| 1245877 | 2180 | 2195 | 21995 | 22010 | GTGGGAGTCGGATTAT | 37 | 275 |
| 1245903 | 2251 | 2266 | 22066 | 22081 | GAGGATAGTCCATGCA | 59 | 276 |
| 1245929 | N/A | N/A | 3437 | 3452 | GATAAGTAGATGGTAA | 59 | 277 |
| 1245955 | N/A | N/A | 3573 | 3588 | TTCTATCAACCTGCAC | 62 | 278 |
| 1245981 | N/A | N/A | 3964 | 3979 | AATACTAATGTCCAAG | 65 | 279 |
| 1246007 | N/A | N/A | 4572 | 4587 | ATATAGCCCTTTCCCC | 26 | 280 |
| 1246033 | N/A | N/A | 5081 | 5096 | CGCCTAAAGGAGATCT | 59 | 281 |
| 1246059 | N/A | N/A | 5241 | 5256 | GTTAGCAAAACACTTG | 71 | 282 |
| 1246085 | N/A | N/A | 5840 | 5855 | AAACATGGATGTTAGG | 56 | 283 |
| 1246111 | N/A | N/A | 6036 | 6051 | TATACTTTTCCGTCTC | 71 | 284 |
| 1246137 | N/A | N/A | 6305 | 6320 | TACTCTAGGAGATATA | 33 | 285 |
| 1246163 | N/A | N/A | 6478 | 6493 | CAACTATGTAATAGGC | 79 | 286 |

TABLE 4-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246189 | N/A | N/A | 7684 | 7699 | AAGAAATTTGTGAACC | 21 | 287 |
| 1246215 | N/A | N/A | 7973 | 7988 | AGTTAATAGGACTAAA | 13 | 288 |
| 1246241 | N/A | N/A | 8246 | 8261 | AACCTAATAACTACAT | 0 | 289 |
| 1246267 | N/A | N/A | 8705 | 8720 | GACCAATATAATCCAA | 34 | 290 |
| 1246293 | N/A | N/A | 9009 | 9024 | GATTAAGGCAAAGATC | 25 | 291 |
| 1246319 | N/A | N/A | 9373 | 9388 | CTAGAACACTTGCCTC | 25 | 292 |
| 1246345 | N/A | N/A | 9540 | 9555 | GAATCCAGATCTGCCC | 29 | 293 |
| 1246371 | N/A | N/A | 9721 | 9736 | GAGGATAGTGAACATA | 50 | 294 |
| 1246397 | N/A | N/A | 9985 | 10000 | CTGTATTAAGACAGTT | 41 | 295 |
| 1246423 | N/A | N/A | 10336 | 10351 | TCCAAATCAGGTAGTT | 22 | 296 |
| 1246449 | N/A | N/A | 10833 | 10848 | GAGTAAACGACTCTGT | 43 | 297 |
| 1246475 | N/A | N/A | 11386 | 11401 | CTTTTAGTCAGGTAGA | 33 | 298 |
| 1246501 | N/A | N/A | 11780 | 11795 | GCTTAATGTTCAGTTT | 50 | 299 |
| 1246527 | N/A | N/A | 12009 | 12024 | AAGCATTGTTAGCTAA | 11 | 300 |
| 1246553 | N/A | N/A | 12465 | 12480 | ATTTATTTGCTGGTCC | 47 | 301 |
| 1246579 | N/A | N/A | 12647 | 12662 | TATACTAGGATTAGAA | 2 | 302 |
| 1246605 | N/A | N/A | 12778 | 12793 | AAATGAGGCGGCACTC | 20 | 303 |
| 1246631 | N/A | N/A | 13704 | 13719 | AATGTAAGAAGCCACG | 26 | 304 |
| 1246657 | N/A | N/A | 13881 | 13896 | CCCAAGAGTGGCAGGA | 29 | 305 |
| 1246683 | N/A | N/A | 14044 | 14059 | CATATCAATGCCTTAG | 29 | 306 |
| 1246709 | N/A | N/A | 14205 | 14220 | GCAGATTATTATGTGA | 59 | 307 |
| 1246735 | N/A | N/A | 14436 | 14451 | TTATACTGAAGGCTGT | 23 | 308 |
| 1246761 | N/A | N/A | 14916 | 14931 | ATACATTAGCAAGCTA | 69 | 309 |
| 1246787 | N/A | N/A | 15319 | 15334 | CTAGGATTAATCATGG | 65 | 310 |
| 1246813 | N/A | N/A | 15420 | 15435 | TCCAGTAGGTGTGTTT | 47 | 311 |
| 1246839 | N/A | N/A | 16116 | 16131 | CTCTATTGGGCCAGGC | 46 | 312 |
| 1246865 | N/A | N/A | 16461 | 16476 | GATATTATGTTCTTGG | 59 | 313 |
| 1246891 | N/A | N/A | 17909 | 17924 | GGAAATTGTTGCTGTT | 46 | 314 |
| 1246917 | N/A | N/A | 18097 | 18112 | GAAATTGATACACCAA | 67 | 315 |
| 1246943 | N/A | N/A | 18819 | 18834 | ATGCTAGTAATTGCAT | 16 | 316 |
| 1246969 | N/A | N/A | 19484 | 19499 | AGAATTAAGGGCTATA | 45 | 317 |
| 1246995 | N/A | N/A | 19689 | 19704 | GATGCTAAAAGCTCAC | 46 | 318 |
| 1247021 | N/A | N/A | 19908 | 19923 | TCTTAAGATACCCAGG | 58 | 319 |
| 1247047 | N/A | N/A | 20189 | 20204 | GTTATTAGAAGTCAGC | 56 | 320 |
| 1247073 | N/A | N/A | 20415 | 20430 | AATTATGCCTTGTGGC | 19 | 321 |

TABLE 5

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245072 | 7 | 22 | 3101 | 3116 | TCCTAGGGAGGAGGTA | 33 | 322 |
| 1245098 | 64 | 79 | 3158 | 3173 | AGGATGATGTTCATGG | 88 | 323 |
| 1245124 | 115 | 130 | 3209 | 3224 | AACGACTCCAAGTAGG | 27 | 324 |
| 1245150 | 205 | 220 | 3299 | 3314 | GTCTGCCTGCCTATTC | 53 | 325 |
| 1245176 | 266 | 281 | N/A | N/A | ACCGCGCTTATTAATA | 4 | 326 |
| 1245202 | 303 | 318 | 7592 | 7607 | CGCCTAGTTTTCGGCA | 23 | 327 |
| 1245228 | 363 | 378 | 7652 | 7667 | TTAGAGAGCGATAGAT | 23 | 328 |
| 1245254 | 406 | 421 | 8800 | 8815 | TTCACCACGATTGTTA | 40 | 329 |
| 1245280 | 436 | 451 | 8830 | 8845 | AGATCGGCTGGATATA | 27 | 330 |
| 1245306 | 479 | 494 | 8873 | 8888 | GACCTCAAATGTCTTG | 12 | 331 |
| 1245332 | 526 | 541 | 10412 | 10427 | ATCGATGGAAGAAGTG | 39 | 332 |
| 1245358 | 573 | 588 | 10459 | 10474 | CGCACACTGAAGCCAC | 56 | 333 |
| 1245384 | 624 | 639 | 12042 | 12057 | CGGCAAATTTGCTGGA | 29 | 334 |
| 1245410 | 690 | 705 | 12108 | 12123 | AGGTTTTGATACCAGT | 60 | 335 |
| 1245436 | 763 | 778 | 15644 | 15659 | TCCAATACAGGCCATA | 62 | 336 |
| 1245462 | 795 | 810 | 15676 | 15691 | CATCTATCAGACTTCT | 38 | 337 |
| 1245488 | 846 | 861 | 15727 | 15742 | AGATATTGATATACGA | 20 | 338 |
| 1245514* | 911 | 926 | 20726 | 20741 | AATATTCTGCATACGA | 70 | 339 |
| 1245540* | 978 | 993 | 20793 | 20808 | ACATCTCTGGCTGGAG | 85 | 340 |
| 1245566 | 1018 | 1033 | 20833 | 20848 | GCAGCATTGATTCGAA | 63 | 341 |
| 1245592 | 1105 | 1120 | 20920 | 20935 | TAATTAATCTTGTTCG | 63 | 342 |
| 1245618 | 1264 | 1279 | 21079 | 21094 | GGGAGGTAGCTTTTGT | 10 | 343 |
| 1245644 | 1318 | 1333 | 21133 | 21148 | TGAACAGTCTTAAACC | 56 | 344 |
| 1245670 | 1345 | 1360 | 21160 | 21175 | GGCATGGCTACAGATT | 69 | 345 |
| 1245696 | 1389 | 1404 | 21204 | 21219 | TCTCTTAGCTGTGCAC | 79 | 346 |
| 1245722 | 1428 | 1443 | 21243 | 21258 | TATGTCCAGGTTGAGA | 64 | 347 |
| 1245748 | 1503 | 1518 | 21318 | 21333 | GAATAGAGTTGCACCG | 55 | 348 |
| 1245774 | 1562 | 1577 | 21377 | 21392 | GGTCCACTTTTGGTGG | 13 | 349 |
| 1245800 | 1621 | 1636 | 21436 | 21451 | GAGTCGGTCACCTTTC | 82 | 350 |
| 1245826 | 1715 | 1730 | 21530 | 21545 | TAAACATCTCTGGGAC | 51 | 351 |
| 1245841 | 1765 | 1780 | 21580 | 21595 | GTACAGTTCCTTTTCC | 58 | 38 |
| 1245852 | 1776 | 1791 | 21591 | 21606 | TGTAATAGCCAGTACA | 46 | 352 |
| 1245878 | 2181 | 2196 | 21996 | 22011 | AGTGGGAGTCGGATTA | 50 | 353 |
| 1245904 | 2252 | 2267 | 22067 | 22082 | AGAGGATAGTCCATGC | 74 | 354 |
| 1245930 | N/A | N/A | 3439 | 3454 | AAGATAAGTAGATGGT | 79 | 355 |
| 1245956 | N/A | N/A | 3602 | 3617 | AGCTTGGAAGGAGACT | 69 | 356 |

TABLE 5-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245982 | N/A | N/A | 3999 | 4014 | GTTAATGTAGTGTTTA | 77 | 357 |
| 1246008 | N/A | N/A | 4573 | 4588 | AATATAGCCCTTTCCC | 44 | 358 |
| 1246034 | N/A | N/A | 5082 | 5097 | TCGCCTAAAGGAGATC | 70 | 359 |
| 1246060 | N/A | N/A | 5267 | 5282 | TGCAAAATGTGATGCC | 69 | 360 |
| 1246065 | N/A | N/A | 5659 | 5674 | ATAAGTTACCAGAGCA | 90 | 48 |
| 1246086 | N/A | N/A | 5841 | 5856 | CAAACATGGATGTTAG | 49 | 361 |
| 1246112 | N/A | N/A | 6037 | 6052 | TTATACTTTTCCGTCT | 61 | 362 |
| 1246138 | N/A | N/A | 6323 | 6338 | ATAGGGAGACCATGCT | 64 | 363 |
| 1246164 | N/A | N/A | 6567 | 6582 | AAAACATTGCTCTTCG | 59 | 364 |
| 1246190 | N/A | N/A | 7751 | 7766 | TAAATCAGGCAGTCAT | 35 | 365 |
| 1246216 | N/A | N/A | 7974 | 7989 | AAGTTAATAGGACTAA | 17 | 366 |
| 1246242 | N/A | N/A | 8248 | 8263 | ATAACCTAATAACTAC | 26 | 367 |
| 1246268 | N/A | N/A | 8714 | 8729 | AAGTTTTGGGACCAAT | 11 | 368 |
| 1246294 | N/A | N/A | 9012 | 9027 | CTTGATTAAGGCAAAG | 38 | 369 |
| 1246320 | N/A | N/A | 9375 | 9390 | ATCTAGAACACTTGCC | 27 | 370 |
| 1246346 | N/A | N/A | 9588 | 9603 | CTGGTAAAGGTAAGGG | 58 | 371 |
| 1246372 | N/A | N/A | 9722 | 9737 | AGAGGATAGTGAACAT | 59 | 372 |
| 1246398 | N/A | N/A | 9986 | 10001 | ACTGTATTAAGACAGT | 20 | 373 |
| 1246424 | N/A | N/A | 10337 | 10352 | TTCCAAATCAGGTAGT | 12 | 374 |
| 1246450 | N/A | N/A | 10834 | 10849 | TGAGTAAACGACTCTG | 23 | 375 |
| 1246476 | N/A | N/A | 11387 | 11402 | ACTTTTAGTCAGGTAG | 26 | 376 |
| 1246502 | N/A | N/A | 11781 | 11796 | GGCTTAATGTTCAGTT | 54 | 377 |
| 1246528 | N/A | N/A | 12011 | 12026 | TTAAGCATTGTTAGCT | 16 | 378 |
| 1246554 | N/A | N/A | 12466 | 12481 | AATTTATTTGCTGGTC | 27 | 379 |
| 1246580 | N/A | N/A | 12648 | 12663 | ATATACTAGGATTAGA | 33 | 380 |
| 1246606 | N/A | N/A | 12779 | 12794 | CAAATGAGGCGGCACT | 32 | 381 |
| 1246632 | N/A | N/A | 13707 | 13722 | GCAAATGTAAGAAGCC | 4 | 382 |
| 1246658 | N/A | N/A | 13894 | 13909 | CTATCATGCCTTCCCC | 1 | 383 |
| 1246684 | N/A | N/A | 14046 | 14061 | TACATATCAATGCCTT | 38 | 384 |
| 1246710 | N/A | N/A | 14206 | 14221 | TGCAGATTATTATGTG | 38 | 385 |
| 1246736 | N/A | N/A | 14437 | 14452 | CTTATACTGAAGGCTG | 48 | 386 |
| 1246762 | N/A | N/A | 14934 | 14949 | CATTATAAGCTAACTA | 39 | 387 |
| 1246788 | N/A | N/A | 15321 | 15336 | GGCTAGGATTAATCAT | 44 | 388 |
| 1246814 | N/A | N/A | 15421 | 15436 | ATCCAGTAGGTGTGTT | 41 | 389 |
| 1246840 | N/A | N/A | 16123 | 16138 | ATAATAGCTCTATTGG | 46 | 390 |
| 1246866 | N/A | N/A | 16533 | 16548 | CAAGACTTAAACACCA | 55 | 391 |

TABLE 5-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246892 | N/A | N/A | 17910 | 17925 | GGGAAATTGTTGCTGT | 42 | 392 |
| 1246918 | N/A | N/A | 18099 | 18114 | CTGAAATTGATACACC | 67 | 393 |
| 1246944 | N/A | N/A | 18827 | 18842 | AAACCTTCATGCTAGT | 27 | 394 |
| 1246970 | N/A | N/A | 19485 | 19500 | TAGAATTAAGGGCTAT | 31 | 395 |
| 1246996 | N/A | N/A | 19699 | 19714 | GATTAATCTTGATGCT | 26 | 396 |
| 1247022 | N/A | N/A | 19909 | 19924 | ATCTTAAGATACCCAG | 70 | 397 |
| 1247048 | N/A | N/A | 20192 | 20207 | GCAGTTATTAGAAGTC | 76 | 398 |
| 1247074 | N/A | N/A | 20419 | 20434 | GTAAAATTATGCCTTG | 50 | 399 |

TABLE 6

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245073 | 8 | 23 | 3102 | 3117 | GTCCTAGGGAGGAGGT | 36 | 400 |
| 1245099 | 65 | 80 | 3159 | 3174 | TAGGATGATGTTCATG | 72 | 401 |
| 1245125 | 116 | 131 | 3210 | 3225 | CAACGACTCCAAGTAG | 0 | 402 |
| 1245151 | 206 | 221 | 3300 | 3315 | AGTCTGCCTGCCTATT | 47 | 403 |
| 1245177 | 267 | 282 | N/A | N/A | CACCGCGCTTATTAAT | 7 | 404 |
| 1245203 | 304 | 319 | 7593 | 7608 | ACGCCTAGTTTTCGGC | 7 | 405 |
| 1245229 | 364 | 379 | 7653 | 7668 | TTTAGAGAGCGATAGA | 13 | 406 |
| 1245255 | 407 | 422 | 8801 | 8816 | ATTCACCACGATTGTT | 0 | 407 |
| 1245281 | 437 | 452 | 8831 | 8846 | AAGATCGGCTGGATAT | 1 | 408 |
| 1245307 | 481 | 496 | 8875 | 8890 | TTGACCTCAAATGTCT | 0 | 409 |
| 1245333 | 527 | 542 | 10413 | 10428 | CATCGATGGAAGAAGT | 16 | 410 |
| 1245359 | 574 | 589 | 10460 | 10475 | CCGCACACTGAAGCCA | 34 | 411 |
| 1245385 | 625 | 640 | 12043 | 12058 | GCGGCAAATTTGCTGG | 0 | 412 |
| 1245411 | 691 | 706 | 12109 | 12124 | GAGGTTTTGATACCAG | 59 | 413 |
| 1245437 | 764 | 779 | 15645 | 15660 | CTCCAATACAGGCCAT | 20 | 414 |
| 1245463 | 796 | 811 | 15677 | 15692 | CCATCTATCAGACTTC | 78 | 415 |
| 1245489 | 847 | 862 | 15728 | 15743 | AAGATATTGATATACG | 45 | 416 |
| 1245515* | 912 | 927 | 20727 | 20742 | GAATATTCTGCATACG | 68 | 417 |
| 1245541* | 979 | 994 | 20794 | 20809 | TACATCTCTGGCTGGA | 86 | 418 |
| 1245567 | 1019 | 1034 | 20834 | 20849 | TGCAGCATTGATTCGA | 47 | 419 |
| 1245593 | 1106 | 1121 | 20921 | 20936 | GTAATTAATCTTGTTC | 52 | 420 |
| 1245619 | 1265 | 1280 | 21080 | 21095 | AGGGAGGTAGCTTTTG | 46 | 421 |

TABLE 6-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245645 | 1319 | 1334 | 21134 | 21149 | TTGAACAGTCTTAAAC | 33 | 422 |
| 1245671 | 1346 | 1361 | 21161 | 21176 | TGGCATGGCTACAGAT | 57 | 423 |
| 1245697 | 1390 | 1405 | 21205 | 21220 | ATCTCTTAGCTGTGCA | 63 | 424 |
| 1245723 | 1429 | 1444 | 21244 | 21259 | ATATGTCCAGGTTGAG | 61 | 425 |
| 1245749 | 1504 | 1519 | 21319 | 21334 | AGAATAGAGTTGCACC | 70 | 426 |
| 1245775 | 1563 | 1578 | 21378 | 21393 | GGGTCCACTTTTGGTG | 13 | 427 |
| 1245801 | 1622 | 1637 | 21437 | 21452 | AGAGTCGGTCACCTTT | 71 | 428 |
| 1245827 | 1718 | 1733 | 21533 | 21548 | GTCTAAACATCTCTGG | 58 | 429 |
| 1245841 | 1765 | 1780 | 21580 | 21595 | GTACAGTTCCTTTTCC | 57 | 38 |
| 1245853 | 1777 | 1792 | 21592 | 21607 | ATGTAATAGCCAGTAC | 52 | 430 |
| 1245879 | 2182 | 2197 | 21997 | 22012 | TAGTGGGAGTCGGATT | 54 | 431 |
| 1245905 | 2253 | 2268 | 22068 | 22083 | AAGAGGATAGTCCATG | 65 | 432 |
| 1245931 | N/A | N/A | 3474 | 3489 | AGGGAATTTATCAAAC | 47 | 433 |
| 1245957 | N/A | N/A | 3610 | 3625 | CATTTAGCAGCTTGGA | 88 | 434 |
| 1245983 | N/A | N/A | 4002 | 4017 | GTTGTTAATGTAGTGT | 77 | 435 |
| 1246009 | N/A | N/A | 4641 | 4656 | ATACGACTTCCTTCTA | 44 | 436 |
| 1246035 | N/A | N/A | 5104 | 5119 | GAAAACTCAGCCAGCA | 78 | 437 |
| 1246061 | N/A | N/A | 5278 | 5293 | AGCTAGACAATTGCAA | 30 | 438 |
| 1246065 | N/A | N/A | 5659 | 5674 | ATAAGTTACCAGAGCA | 87 | 48 |
| 1246087 | N/A | N/A | 5842 | 5857 | CCAAACATGGATGTTA | 43 | 439 |
| 1246113 | N/A | N/A | 6038 | 6053 | ATTATACTTTTCCGTC | 75 | 440 |
| 1246139 | N/A | N/A | 6327 | 6342 | TTTCATAGGGAGACCA | 71 | 441 |
| 1246165 | N/A | N/A | 6607 | 6622 | CTAAAGCAGGCTACTT | 32 | 442 |
| 1246191 | N/A | N/A | 7752 | 7767 | TTAAATCAGGCAGTCA | 45 | 443 |
| 1246217 | N/A | N/A | 7975 | 7990 | AAAGTTAATAGGACTA | 12 | 444 |
| 1246243 | N/A | N/A | 8249 | 8264 | CATAACCTAATAACTA | 10 | 445 |
| 1246269 | N/A | N/A | 8717 | 8732 | TCAAAGTTTTGGGACC | 42 | 446 |
| 1246295 | N/A | N/A | 9080 | 9095 | TCCACTTGAATTCTGT | 32 | 447 |
| 1246321 | N/A | N/A | 9376 | 9391 | GATCTAGAACACTTGC | 27 | 448 |
| 1246347 | N/A | N/A | 9589 | 9604 | GCTGGTAAAGGTAAGG | 65 | 449 |
| 1246373 | N/A | N/A | 9751 | 9766 | CTCCAAATTCCCAACC | 31 | 450 |
| 1246399 | N/A | N/A | 9998 | 10013 | AAATCTTGTGTAACTG | 41 | 451 |
| 1246425 | N/A | N/A | 10359 | 10374 | GACAATGACATAGACG | 0 | 452 |
| 1246451 | N/A | N/A | 10835 | 10850 | CTGAGTAAACGACTCT | 33 | 453 |
| 1246477 | N/A | N/A | 11389 | 11404 | CAACTTTTAGTCAGGT | 66 | 454 |
| 1246503 | N/A | N/A | 11782 | 11797 | TGGCTTAATGTTCAGT | 50 | 455 |

TABLE 6-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246529 | N/A | N/A | 12012 | 12027 | ATTAAGCATTGTTAGC | 0 | 456 |
| 1246555 | N/A | N/A | 12467 | 12482 | CAATTTATTTGCTGGT | 31 | 457 |
| 1246581 | N/A | N/A | 12649 | 12664 | TATATACTAGGATTAG | 10 | 458 |
| 1246607 | N/A | N/A | 12781 | 12796 | CTCAAATGAGGCGGCA | 56 | 459 |
| 1246633 | N/A | N/A | 13711 | 13726 | CGTAGCAAATGTAAGA | 0 | 460 |
| 1246659 | N/A | N/A | 13896 | 13911 | ATCTATCATGCCTTCC | 6 | 461 |
| 1246685 | N/A | N/A | 14047 | 14062 | TTACATATCAATGCCT | 12 | 462 |
| 1246711 | N/A | N/A | 14243 | 14258 | GTTAAAACTTCATTCC | 5 | 463 |
| 1246737 | N/A | N/A | 14438 | 14453 | CCTTATACTGAAGGCT | 41 | 464 |
| 1246763 | N/A | N/A | 14935 | 14950 | TCATTATAAGCTAACT | 0 | 465 |
| 1246789 | N/A | N/A | 15328 | 15343 | GAGGAATGGCTAGGAT | 47 | 466 |
| 1246815 | N/A | N/A | 15424 | 15439 | CATATCCAGTAGGTGT | 37 | 467 |
| 1246841 | N/A | N/A | 16128 | 16143 | CCATAATAATAGCTCT | 48 | 468 |
| 1246867 | N/A | N/A | 16755 | 16770 | AAAGTTAGTTGGGCGA | 26 | 469 |
| 1246893 | N/A | N/A | 17911 | 17926 | TGGGAAATTGTTGCTG | 38 | 470 |
| 1246919 | N/A | N/A | 18100 | 18115 | ACTGAAATTGATACAC | 49 | 471 |
| 1246945 | N/A | N/A | 18828 | 18843 | GAAACCTTCATGCTAG | 31 | 472 |
| 1246971 | N/A | N/A | 19486 | 19501 | CTAGAATTAAGGGCTA | 42 | 473 |
| 1246997 | N/A | N/A | 19700 | 19715 | TGATTAATCTTGATGC | 15 | 474 |
| 1247023 | N/A | N/A | 19910 | 19925 | CATCTTAAGATACCCA | 76 | 475 |
| 1247049 | N/A | N/A | 20248 | 20263 | CCTAAACAAACACTAT | 8 | 476 |
| 1247075 | N/A | N/A | 20422 | 20437 | ACAGTAAAATTATGCC | 73 | 477 |

TABLE 7

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245074 | 10 | 25 | 3104 | 3119 | TAGTCCTAGGGAGGAG | 68 | 478 |
| 1245100 | 66 | 81 | 3160 | 3175 | CTAGGATGATGTTCAT | 47 | 479 |
| 1245126 | 117 | 132 | 3211 | 3226 | CCAACGACTCCAAGTA | 20 | 480 |
| 1245152 | 207 | 222 | 3301 | 3316 | TAGTCTGCCTGCCTAT | 44 | 481 |
| 1245178 | 268 | 283 | N/A | N/A | ACACCGCGCTTATTAA | 7 | 482 |
| 1245204 | 316 | 331 | 7605 | 7620 | GCATGCGCAGTGACGC | 36 | 483 |
| 1245230 | 365 | 380 | 7654 | 7669 | ATTTAGAGAGCGATAG | 14 | 484 |

TABLE 7-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245256 | 408 | 423 | 8802 | 8817 | TATTCACCACGATTGT | 2 | 485 |
| 1245282 | 438 | 453 | 8832 | 8847 | GAAGATCGGCTGGATA | 16 | 486 |
| 1245308 | 482 | 497 | 8876 | 8891 | GTTGACCTCAAATGTC | 0 | 487 |
| 1245334 | 528 | 543 | 10414 | 10429 | TCATCGATGGAAGAAG | 24 | 488 |
| 1245360 | 575 | 590 | 10461 | 10476 | GCCGCACACTGAAGCC | 25 | 489 |
| 1245386 | 626 | 641 | 12044 | 12059 | AGCGGCAAATTTGCTG | 5 | 490 |
| 1245412 | 692 | 707 | 12110 | 12125 | TGAGGTTTTGATACCA | 63 | 491 |
| 1245438 | 765 | 780 | 15646 | 15661 | TCTCCAATACAGGCCA | 21 | 492 |
| 1245464 | 797 | 812 | 15678 | 15693 | TCCATCTATCAGACTT | 42 | 493 |
| 1245490* | 858 | 873 | 15739 | 15754 | GTAGTCTCAGAAAGAT | 45 | 494 |
| 1245516* | 926 | 941 | 20741 | 20756 | CACTGCTTCAAATTGA | 64 | 495 |
| 1245542* | 980 | 995 | 20795 | 20810 | ATACATCTCTGGCTGG | 88 | 496 |
| 1245568 | 1020 | 1035 | 20835 | 20850 | TTGCAGCATTGATTCG | 59 | 497 |
| 1245594 | 1107 | 1122 | 20922 | 20937 | GGTAATTAATCTTGTT | 58 | 498 |
| 1245620 | 1266 | 1281 | 21081 | 21096 | TAGGGAGGTAGCTTTT | 46 | 499 |
| 1245646 | 1320 | 1335 | 21135 | 21150 | CTTGAACAGTCTTAAA | 39 | 500 |
| 1245672 | 1347 | 1362 | 21162 | 21177 | GTGGCATGGCTACAGA | 56 | 501 |
| 1245698 | 1391 | 1406 | 21206 | 21221 | GATCTCTTAGCTGTGC | 64 | 502 |
| 1245724 | 1430 | 1445 | 21245 | 21260 | AATATGTCCAGGTTGA | 64 | 503 |
| 1245750 | 1505 | 1520 | 21320 | 21335 | CAGAATAGAGTTGCAC | 50 | 504 |
| 1245776 | 1564 | 1579 | 21379 | 21394 | AGGGTCCACTTTTGGT | 11 | 505 |
| 1245802 | 1623 | 1638 | 21438 | 21453 | TAGAGTCGGTCACCTT | 65 | 506 |
| 1245828 | 1719 | 1734 | 21534 | 21549 | TGTCTAAACATCTCTG | 58 | 507 |
| 1245841 | 1765 | 1780 | 21580 | 21595 | GTACAGTTCCTTTTCC | 51 | 38 |
| 1245854 | 1778 | 1793 | 21593 | 21608 | TATGTAATAGCCAGTA | 50 | 508 |
| 1245880 | 2183 | 2198 | 21998 | 22013 | GTAGTGGGAGTCGGAT | 48 | 509 |
| 1245906 | 2254 | 2269 | 22069 | 22084 | CAAGAGGATAGTCCAT | 58 | 510 |
| 1245932 | N/A | N/A | 3487 | 3502 | AGACTAAGGGACCAGG | 80 | 511 |
| 1245958 | N/A | N/A | 3611 | 3626 | TCATTTAGCAGCTTGG | 79 | 512 |
| 1245984 | N/A | N/A | 4123 | 4138 | ACAATTTTTCCAATCC | 86 | 513 |
| 1246010 | N/A | N/A | 4642 | 4657 | AATACGACTTCCTTCT | 26 | 514 |
| 1246036 | N/A | N/A | 5105 | 5120 | TGAAAACTCAGCCAGC | 77 | 515 |
| 1246062 | N/A | N/A | 5287 | 5302 | TTATAACTGAGCTAGA | 8 | 516 |
| 1246065 | N/A | N/A | 5659 | 5674 | ATAAGTTACCAGAGCA | 89 | 48 |
| 1246088 | N/A | N/A | 5843 | 5858 | CCCAAACATGGATGTT | 72 | 517 |

TABLE 7-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246114 | N/A | N/A | 6039 | 6054 | AATTATACTTTTCCGT | 66 | 518 |
| 1246140 | N/A | N/A | 6328 | 6343 | CTTTCATAGGGAGACC | 73 | 519 |
| 1246166 | N/A | N/A | 6608 | 6623 | TCTAAAGCAGGCTACT | 32 | 520 |
| 1246192 | N/A | N/A | 7757 | 7772 | CCAATTTAAATCAGGC | 73 | 521 |
| 1246218 | N/A | N/A | 7976 | 7991 | CAAAGTTAATAGGACT | 50 | 522 |
| 1246244 | N/A | N/A | 8280 | 8295 | GTCTAAAGTGCTGGTT | 39 | 523 |
| 1246270 | N/A | N/A | 8747 | 8762 | GAACACTTTCACTGGG | 0 | 524 |
| 1246296 | N/A | N/A | 9110 | 9125 | ACCAAGTAGCTTACAT | 2 | 525 |
| 1246322 | N/A | N/A | 9377 | 9392 | GGATCTAGAACACTTG | 32 | 526 |
| 1246348 | N/A | N/A | 9598 | 9613 | ATGTGAAGAGCTGGTA | 42 | 527 |
| 1246374 | N/A | N/A | 9761 | 9776 | CCCAAGCTACCTCCAA | 15 | 528 |
| 1246400 | N/A | N/A | 10001 | 10016 | GTGAAATCTTGTGTAA | 44 | 529 |
| 1246426 | N/A | N/A | 10360 | 10375 | AGACAATGACATAGAC | 14 | 530 |
| 1246452 | N/A | N/A | 10836 | 10851 | ACTGAGTAAACGACTC | 45 | 531 |
| 1246478 | N/A | N/A | 11428 | 11443 | CCCTTTATGTCTTTGG | 35 | 532 |
| 1246504 | N/A | N/A | 11790 | 11805 | CTATTGATTGGCTTAA | 31 | 533 |
| 1246530 | N/A | N/A | 12038 | 12053 | AAATTTGCTGGAACTG | 15 | 534 |
| 1246556 | N/A | N/A | 12478 | 12493 | AGCTAGATACTCAATT | 2 | 535 |
| 1246582 | N/A | N/A | 12652 | 12667 | GAATATATACTAGGAT | 5 | 536 |
| 1246608 | N/A | N/A | 12782 | 12797 | CCTCAAATGAGGCGGC | 47 | 537 |
| 1246634 | N/A | N/A | 13730 | 13745 | ATTAAGTACTGTGAGA | 1 | 538 |
| 1246660 | N/A | N/A | 13897 | 13912 | CATCTATCATGCCTTC | 18 | 539 |
| 1246686 | N/A | N/A | 14048 | 14063 | ATTACATATCAATGCC | 36 | 540 |
| 1246712 | N/A | N/A | 14250 | 14265 | AGCGAATGTTAAAACT | 16 | 541 |
| 1246738 | N/A | N/A | 14439 | 14454 | TCCTTATACTGAAGGC | 22 | 542 |
| 1246764 | N/A | N/A | 14936 | 14951 | CTCATTATAAGCTAAC | 13 | 543 |
| 1246790 | N/A | N/A | 15350 | 15365 | AGTAGTGGAGCCAGAC | 39 | 544 |
| 1246816 | N/A | N/A | 15425 | 15440 | TCATATCCAGTAGGTG | 32 | 545 |
| 1246842 | N/A | N/A | 16129 | 16144 | TCCATAATAATAGCTC | 69 | 546 |
| 1246868 | N/A | N/A | 16905 | 16920 | CGTCAAAAACCGTCAA | 20 | 547 |
| 1246894 | N/A | N/A | 17923 | 17938 | GAGTATTCCTCTGGG | 23 | 548 |
| 1246920 | N/A | N/A | 18506 | 18521 | ACTAATTTAGTCAACT | 18 | 549 |
| 1246946 | N/A | N/A | 18846 | 18861 | TTTAACTACCCTCACA | 0 | 550 |
| 1246972 | N/A | N/A | 19487 | 19502 | TCTAGAATTAAGGGCT | 45 | 551 |
| 1246998 | N/A | N/A | 19701 | 19716 | CTGATTAATCTTGATG | 32 | 552 |
| 1247024 | N/A | N/A | 19911 | 19926 | GCATCTTAAGATACCC | 82 | 553 |

TABLE 7-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1247050 | N/A | N/A | 20249 | 20264 | GCCTAAACAAACACTA | 37 | 554 |
| 1247076 | N/A | N/A | 20481 | 20496 | CATAGTGGACTTCATT | 34 | 555 |

TABLE 8

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245075 | 11 | 26 | 3105 | 3120 | GTAGTCCTAGGGAGGA | 77 | 556 |
| 1245101 | 67 | 82 | 3161 | 3176 | TCTAGGATGATGTTCA | 64 | 557 |
| 1245127 | 118 | 133 | 3212 | 3227 | ACCAACGACTCCAAGT | 16 | 558 |
| 1245153 | 208 | 223 | 3302 | 3317 | GTAGTCTGCCTGCCTA | 68 | 559 |
| 1245179 | 269 | 284 | N/A | N/A | CACACCGCGCTTATTA | 11 | 560 |
| 1245205 | 317 | 332 | 7606 | 7621 | CGCATGCGCAGTGACG | 46 | 561 |
| 1245231 | 366 | 381 | 7655 | 7670 | GATTTAGAGAGCGATA | 44 | 562 |
| 1245257 | 409 | 424 | 8803 | 8818 | TTATTCACCACGATTG | 40 | 563 |
| 1245283 | 439 | 454 | 8833 | 8848 | AGAAGATCGGCTGGAT | 29 | 564 |
| 1245309 | 483 | 498 | 8877 | 8892 | TGTTGACCTCAAATGT | 14 | 565 |
| 1245335 | 529 | 544 | 10415 | 10430 | ATCATCGATGGAAGAA | 30 | 566 |
| 1245361 | 576 | 591 | 10462 | 10477 | GGCCGCACACTGAAGC | 9 | 567 |
| 1245387 | 632 | 647 | 12050 | 12065 | GCCAACAGCGGCAAAT | 30 | 568 |
| 1245413 | 693 | 708 | 12111 | 12126 | ATGAGGTTTTGATACC | 47 | 569 |
| 1245439 | 766 | 781 | 15647 | 15662 | GTCTCCAATACAGGCC | 47 | 570 |
| 1245465 | 798 | 813 | 15679 | 15694 | TTCCATCTATCAGACT | 33 | 571 |
| 1245491* | 866 | 881 | N/A | N/A | AAACTTCTGTAGTCTC | 67 | 572 |
| 1245517* | 927 | 942 | 20742 | 20757 | CCACTGCTTCAAATTG | 77 | 573 |
| 1245543* | 981 | 996 | 20796 | 20811 | CATACATCTCTGGCTG | 69 | 574 |
| 1245569 | 1021 | 1036 | 20836 | 20851 | TTTGCAGCATTGATTC | 53 | 575 |
| 1245595 | 1109 | 1124 | 20924 | 20939 | CAGGTAATTAATCTTG | 54 | 576 |
| 1245621 | 1267 | 1282 | 21082 | 21097 | TTAGGGAGGTAGCTTT | 54 | 577 |
| 1245647 | 1321 | 1336 | 21136 | 21151 | ACTTGAACAGTCTTAA | 63 | 578 |
| 1245673 | 1348 | 1363 | 21163 | 21178 | TGTGGCATGGCTACAG | 24 | 579 |
| 1245699 | 1392 | 1407 | 21207 | 21222 | TGATCTCTTAGCTGTG | 59 | 580 |
| 1245725 | 1431 | 1446 | 21246 | 21261 | AAATATGTCCAGGTTG | 68 | 581 |

TABLE 8-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245751 | 1506 | 1521 | 21321 | 21336 | CCAGAATAGAGTTGCA | 62 | 582 |
| 1245777 | 1565 | 1580 | 21380 | 21395 | GAGGGTCCACTTTTGG | 23 | 583 |
| 1245803 | 1624 | 1639 | 21439 | 21454 | ATAGAGTCGGTCACCT | 60 | 584 |
| 1245829 | 1721 | 1736 | 21536 | 21551 | ATTGTCTAAACATCTC | 84 | 585 |
| 1245855 | 1779 | 1794 | 21594 | 21609 | TTATGTAATAGCCAGT | 77 | 586 |
| 1245881 | 2184 | 2199 | 21999 | 22014 | TGTAGTGGGAGTCGGA | 62 | 587 |
| 1245907 | 2255 | 2270 | 22070 | 22085 | ACAAGAGGATAGTCCA | 64 | 588 |
| 1245933 | N/A | N/A | 3488 | 3503 | CAGACTAAGGGACCAG | 75 | 589 |
| 1245959 | N/A | N/A | 3612 | 3627 | CTCATTTAGCAGCTTG | 70 | 590 |
| 1245985 | N/A | N/A | 4136 | 4151 | CAAGGAGTACTTCACA | 66 | 591 |
| 1246011 | N/A | N/A | 4643 | 4658 | TAATACGACTTCCTTC | 32 | 592 |
| 1246037 | N/A | N/A | 5125 | 5140 | GCAAAAGGAGCCAGTT | 57 | 593 |
| 1246063 | N/A | N/A | 5290 | 5305 | GTTTTATAACTGAGCT | 84 | 594 |
| 1246089 | N/A | N/A | 5871 | 5886 | CTAAACCCTGGAGCAG | 42 | 595 |
| 1246115 | N/A | N/A | 6040 | 6055 | AAATTATACTTTTCCG | 85 | 596 |
| 1246141 | N/A | N/A | 6337 | 6352 | GAAGAAGGACTTTCAT | 40 | 597 |
| 1246167 | N/A | N/A | 6609 | 6624 | CTCTAAAGCAGGCTAC | 51 | 598 |
| 1246193 | N/A | N/A | 7758 | 7773 | TCCAATTTAAATCAGG | 61 | 599 |
| 1246219 | N/A | N/A | 7977 | 7992 | GCAAAGTTAATAGGAC | 52 | 600 |
| 1246245 | N/A | N/A | 8282 | 8297 | TGGTCTAAAGTGCTGG | 61 | 601 |
| 1246271 | N/A | N/A | 8895 | 8910 | CCCAAAAATGTCCTAG | 18 | 602 |
| 1246297 | N/A | N/A | 9111 | 9126 | GACCAAGTAGCTTACA | 28 | 603 |
| 1246323 | N/A | N/A | 9379 | 9394 | ATGGATCTAGAACACT | 43 | 604 |
| 1246349 | N/A | N/A | 9600 | 9615 | ATATGTGAAGAGCTGG | 51 | 605 |
| 1246375 | N/A | N/A | 9762 | 9777 | ACCCAAGCTACCTCCA | 9 | 606 |
| 1246401 | N/A | N/A | 10002 | 10017 | AGTGAAATCTTGTGTA | 41 | 607 |
| 1246427 | N/A | N/A | 10380 | 10395 | GATCATTGCAGAAAGA | 23 | 608 |
| 1246453 | N/A | N/A | 10849 | 10864 | ACATATGGTGTACACT | 19 | 609 |
| 1246479 | N/A | N/A | 11468 | 11483 | GCAAATACAGCAGTAC | 56 | 610 |
| 1246505 | N/A | N/A | 11791 | 11806 | TCTATTGATTGGCTTA | 39 | 611 |
| 1246531 | N/A | N/A | 12039 | 12054 | CAAATTTGCTGGAACT | 39 | 612 |
| 1246557 | N/A | N/A | 12482 | 12497 | AAGGAGCTAGATACTC | 19 | 613 |
| 1246583 | N/A | N/A | 12654 | 12669 | CAGAATATATACTAGG | 55 | 614 |
| 1246609 | N/A | N/A | 12795 | 12810 | TAAGAGTCAGTATCCT | 52 | 615 |
| 1246635 | N/A | N/A | 13731 | 13746 | TATTAAGTACTGTGAG | 0 | 616 |
| 1246661 | N/A | N/A | 13915 | 13930 | CATTATCCTTACTCCC | 16 | 617 |

TABLE 8-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246687 | N/A | N/A | 14049 | 14064 | CATTACATATCAATGC | 29 | 618 |
| 1246713 | N/A | N/A | 14262 | 14277 | AGTTAGGGAGCCAGCG | 38 | 619 |
| 1246739 | N/A | N/A | 14465 | 14480 | CTGGAGGTATGTCATA | 23 | 620 |
| 1246765 | N/A | N/A | 15022 | 15037 | TGATAAAATAGGGTGC | 44 | 621 |
| 1246791 | N/A | N/A | 15351 | 15366 | GAGTAGTGGAGCCAGA | 44 | 622 |
| 1246817 | N/A | N/A | 15427 | 15442 | TTTCATATCCAGTAGG | 36 | 623 |
| 1246843 | N/A | N/A | 16189 | 16204 | AATAACTGTTCTCCCC | 20 | 624 |
| 1246869 | N/A | N/A | 16956 | 16971 | GACAACAAACAATGGG | 39 | 625 |
| 1246895 | N/A | N/A | 17924 | 17939 | AGAGTATTCCTCTGG | 32 | 626 |
| 1246921 | N/A | N/A | 18507 | 18522 | CACTAATTTAGTCAAC | 7 | 627 |
| 1246947 | N/A | N/A | 18847 | 18862 | TTTTAACTACCCTCAC | 2 | 628 |
| 1246973 | N/A | N/A | 19488 | 19503 | ATCTAGAATTAAGGGC | 41 | 629 |
| 1246999 | N/A | N/A | 19702 | 19717 | GCTGATTAATCTTGAT | 48 | 630 |
| 1247025 | N/A | N/A | 19921 | 19936 | TCCAAGGAGTGCATCT | 46 | 631 |
| 1247051 | N/A | N/A | 20356 | 20371 | TTATTGCCTGAACACA | 58 | 632 |
| 1247077 | N/A | N/A | 20482 | 20497 | TCATAGTGGACTTCAT | 36 | 633 |

TABLE 9

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245076 | 12 | 27 | 3106 | 3121 | TGTAGTCCTAGGGAGG | 86 | 634 |
| 1245102 | 68 | 83 | 3162 | 3177 | TTCTAGGATGATGTTC | 72 | 635 |
| 1245128 | 119 | 134 | 3213 | 3228 | CACCAACGACTCCAAG | 16 | 636 |
| 1245154 | 211 | 226 | 3305 | 3320 | TAAGTAGTCTGCCTGC | 19 | 637 |
| 1245180 | 271 | 286 | N/A | N/A | TCCACACCGCGCTTAT | 32 | 638 |
| 1245206 | 318 | 333 | 7607 | 7622 | ACGCATGCGCAGTGAC | 52 | 639 |
| 1245232 | 367 | 382 | 7656 | 7671 | TGATTTAGAGAGCGAT | 35 | 640 |
| 1245258 | 410 | 425 | 8804 | 8819 | ATTATTCACCACGATT | 29 | 641 |
| 1245284 | 440 | 455 | 8834 | 8849 | GAGAAGATCGGCTGGA | 6 | 642 |
| 1245310 | 484 | 499 | 8878 | 8893 | ATGTTGACCTCAAATG | 0 | 643 |
| 1245336 | 530 | 545 | 10416 | 10431 | CATCATCGATGGAAGA | 14 | 644 |
| 1245362 | 577 | 592 | 10463 | 10478 | TGGCCGCACACTGAAG | 0 | 645 |

TABLE 9-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245388 | 638 | 653 | 12056 | 12071 | GTGAAAGCCAACAGCG | 62 | 646 |
| 1245414 | 696 | 711 | 12114 | 12129 | GACATGAGGTTTTGAT | 52 | 647 |
| 1245440 | 767 | 782 | 15648 | 15663 | TGTCTCCAATACAGGC | 39 | 648 |
| 1245466 | 799 | 814 | 15680 | 15695 | ATTCCATCTATCAGAC | 7 | 649 |
| 1245492* | 867 | 882 | N/A | N/A | GAAACTTCTGTAGTCT | 86 | 650 |
| 1245518* | 931 | 946 | 20746 | 20761 | CCAACCACTGCTTCAA | 98 | 651 |
| 1245544* | 982 | 997 | 20797 | 20812 | GCATACATCTCTGGCT | 27 | 652 |
| 1245570 | 1023 | 1038 | 20838 | 20853 | GCTTTGCAGCATTGAT | 61 | 653 |
| 1245596 | 1110 | 1125 | 20925 | 20940 | ACAGGTAATTAATCTT | 39 | 654 |
| 1245622 | 1268 | 1283 | 21083 | 21098 | TTTAGGGAGGTAGCTT | 24 | 655 |
| 1245648 | 1322 | 1337 | 21137 | 21152 | TACTTGAACAGTCTTA | 48 | 656 |
| 1245674 | 1349 | 1364 | 21164 | 21179 | CTGTGGCATGGCTACA | 66 | 657 |
| 1245700 | 1393 | 1408 | 21208 | 21223 | TTGATCTCTTAGCTGT | 74 | 658 |
| 1245726 | 1461 | 1476 | 21276 | 21291 | CTAGGGAAATCTTTCA | 48 | 659 |
| 1245752 | 1507 | 1522 | 21322 | 21337 | TCCAGAATAGAGTTGC | 46 | 660 |
| 1245778 | 1566 | 1581 | 21381 | 21396 | AGAGGGTCCACTTTTG | 34 | 661 |
| 1245804 | 1625 | 1640 | 21440 | 21455 | AATAGAGTCGGTCACC | 58 | 662 |
| 1245830 | 1728 | 1743 | 21543 | 21558 | GCCTAAAATTGTCTAA | 32 | 663 |
| 1245841 | 1765 | 1780 | 21580 | 21595 | GTACAGTTCCTTTTCC | 49 | 38 |
| 1245856 | 1780 | 1795 | 21595 | 21610 | CTTATGTAATAGCCAG | 74 | 664 |
| 1245882 | 2185 | 2200 | 22000 | 22015 | ATGTAGTGGGAGTCGG | 72 | 665 |
| 1245908 | 2256 | 2271 | 22071 | 22086 | AACAAGAGGATAGTCC | 54 | 666 |
| 1245934 | N/A | N/A | 3489 | 3504 | ACAGACTAAGGGACCA | 68 | 667 |
| 1245960 | N/A | N/A | 3613 | 3628 | CCTCATTTAGCAGCTT | 81 | 668 |
| 1245986 | N/A | N/A | 4138 | 4153 | CTCAAGGAGTACTTCA | 82 | 669 |
| 1246012 | N/A | N/A | 4644 | 4659 | TTAATACGACTTCCTT | 35 | 670 |
| 1246038 | N/A | N/A | 5126 | 5141 | GGCAAAAGGAGCCAGT | 43 | 671 |
| 1246064 | N/A | N/A | 5655 | 5670 | GTTACCAGAGCATTCA | 73 | 672 |
| 1246065 | N/A | N/A | 5659 | 5674 | ATAAGTTACCAGAGCA | 89 | 48 |
| 1246090 | N/A | N/A | 5872 | 5887 | GCTAAACCCTGGAGCA | 5 | 673 |
| 1246116 | N/A | N/A | 6089 | 6104 | CAAGTTTTCACCTCAG | 93 | 674 |
| 1246142 | N/A | N/A | 6357 | 6372 | GGGAAAGAAGTCTCCT | 13 | 675 |
| 1246168 | N/A | N/A | 6610 | 6625 | TCTCTAAAGCAGGCTA | 60 | 676 |
| 1246194 | N/A | N/A | 7770 | 7785 | TAGCAGCTAAAATCCA | 66 | 677 |
| 1246220 | N/A | N/A | 7978 | 7993 | TGCAAAGTTAATAGGA | 43 | 678 |
| 1246246 | N/A | N/A | 8487 | 8502 | CTATATAAATTCTGAC | 0 | 679 |

TABLE 9-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246272 | N/A | N/A | 8939 | 8954 | TAAGAGAAGGTGCACA | 12 | 680 |
| 1246298 | N/A | N/A | 9130 | 9145 | GATACTGGTGGACAAG | 13 | 681 |
| 1246324 | N/A | N/A | 9410 | 9425 | GTATAGCTGCATTTCT | 35 | 682 |
| 1246350 | N/A | N/A | 9601 | 9616 | CATATGTGAAGAGCTG | 25 | 683 |
| 1246376 | N/A | N/A | 9776 | 9791 | AACTAGAACTCCCAAC | 0 | 684 |
| 1246402 | N/A | N/A | 10025 | 10040 | GGCTTTATCATTCTAA | 20 | 685 |
| 1246428 | N/A | N/A | 10384 | 10399 | TAAGGATCATTGCAGA | 0 | 686 |
| 1246454 | N/A | N/A | 10855 | 10870 | CCATTTACATATGGTG | 28 | 687 |
| 1246480 | N/A | N/A | 11469 | 11484 | GGCAAATACAGCAGTA | 64 | 688 |
| 1246506 | N/A | N/A | 11792 | 11807 | CTCTATTGATTGGCTT | 65 | 689 |
| 1246532 | N/A | N/A | 12168 | 12183 | CTTACCTTGTGCTTGG | 34 | 690 |
| 1246558 | N/A | N/A | 12486 | 12501 | GACTAAGGAGCTAGAT | 25 | 691 |
| 1246584 | N/A | N/A | 12655 | 12670 | GCAGAATATATACTAG | 55 | 692 |
| 1246610 | N/A | N/A | 12799 | 12814 | GCTGTAAGAGTCAGTA | 89 | 693 |
| 1246636 | N/A | N/A | 13733 | 13748 | CTTATTAAGTACTGTG | 0 | 694 |
| 1246662 | N/A | N/A | 13916 | 13931 | CCATTATCCTTACTCC | 27 | 695 |
| 1246688 | N/A | N/A | 14089 | 14104 | CTACATGGATCCAACA | 5 | 696 |
| 1246714 | N/A | N/A | 14266 | 14281 | GAGGAGTTAGGGAGCC | 36 | 697 |
| 1246740 | N/A | N/A | 14469 | 14484 | ACAACTGGAGGTATGT | 0 | 698 |
| 1246766 | N/A | N/A | 15023 | 15038 | TTGATAAAATAGGGTG | 46 | 699 |
| 1246792 | N/A | N/A | 15353 | 15368 | AGGAGTAGTGGAGCCA | 16 | 700 |
| 1246818 | N/A | N/A | 15443 | 15458 | TATCAGAAACTTATAC | 0 | 701 |
| 1246844 | N/A | N/A | 16191 | 16206 | GAAATAACTGTTCTCC | 32 | 702 |
| 1246870 | N/A | N/A | 16969 | 16984 | TCCAATATATACTGAC | 72 | 703 |
| 1246896 | N/A | N/A | 17930 | 17945 | GCTGAGAGAGTATTTC | 51 | 704 |
| 1246922 | N/A | N/A | 18508 | 18523 | ACACTAATTTAGTCAA | 16 | 705 |
| 1246948 | N/A | N/A | 18848 | 18863 | CTTTTAACTACCCTCA | 16 | 706 |
| 1246974 | N/A | N/A | 19490 | 19505 | CCATCTAGAATTAAGG | 0 | 707 |
| 1247000 | N/A | N/A | 19731 | 19746 | ACTGAAGGTCTGAGCT | 20 | 708 |
| 1247026 | N/A | N/A | 19922 | 19937 | CTCCAAGGAGTGCATC | 53 | 709 |
| 1247052 | N/A | N/A | 20359 | 20374 | AAATTATTGCCTGAAC | 32 | 710 |
| 1247078 | N/A | N/A | 20484 | 20499 | CTTCATAGTGGACTTC | 79 | 711 |

TABLE 10

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245077 | 13 | 28 | 3107 | 3122 | GTGTAGTCCTAGGGAG | 67 | 712 |
| 1245103 | 71 | 86 | 3165 | 3180 | GATTTCTAGGATGATG | 57 | 713 |
| 1245129 | 120 | 135 | 3214 | 3229 | TCACCAACGACTCCAA | 19 | 714 |
| 1245155 | 212 | 227 | 3306 | 3321 | ATAAGTAGTCTGCCTG | 43 | 715 |
| 1245181 | 272 | 287 | N/A | N/A | CTCCACACCGCGCTTA | 7 | 716 |
| 1245207 | 319 | 334 | 7608 | 7623 | TACGCATGCGCAGTGA | 60 | 717 |
| 1245233 | 368 | 383 | 7657 | 7672 | CTGATTTAGAGAGCGA | 61 | 718 |
| 1245259 | 411 | 426 | 8805 | 8820 | CATTATTCACCACGAT | 33 | 719 |
| 1245285 | 441 | 456 | 8835 | 8850 | TGAGAAGATCGGCTGG | 37 | 720 |
| 1245311 | 485 | 500 | 8879 | 8894 | GATGTTGACCTCAAAT | 0 | 721 |
| 1245337 | 531 | 546 | 10417 | 10432 | CCATCATCGATGGAAG | 8 | 722 |
| 1245363 | 578 | 593 | 10464 | 10479 | GTGGCCGCACACTGAA | 41 | 723 |
| 1245389 | 642 | 657 | 12060 | 12075 | CTCTGTGAAAGCCAAC | 50 | 724 |
| 1245415 | 698 | 713 | 12116 | 12131 | GAGACATGAGGTTTTG | 77 | 725 |
| 1245441 | 768 | 783 | 15649 | 15664 | CTGTCTCCAATACAGG | 29 | 726 |
| 1245467 | 801 | 816 | 15682 | 15697 | GTATTCCATCTATCAG | 52 | 727 |
| 1245493* | 877 | 892 | N/A | N/A | CGTTCAGGAAGAAACT | 70 | 728 |
| 1245519* | 932 | 947 | 20747 | 20762 | GCCAACCACTGCTTCA | 97 | 729 |
| 1245545* | 983 | 998 | 20798 | 20813 | TGCATACATCTCTGGC | 53 | 730 |
| 1245571 | 1024 | 1039 | 20839 | 20854 | AGCTTTGCAGCATTGA | 62 | 731 |
| 1245597 | 1111 | 1126 | 20926 | 20941 | GACAGGTAATTAATCT | 60 | 732 |
| 1245623 | 1269 | 1284 | 21084 | 21099 | TTTTAGGGAGGTAGCT | 39 | 733 |
| 1245649 | 1323 | 1338 | 21138 | 21153 | CTACTTGAACAGTCTT | 80 | 734 |
| 1245675 | 1350 | 1365 | 21165 | 21180 | TCTGTGGCATGGCTAC | 67 | 735 |
| 1245701 | 1394 | 1409 | 21209 | 21224 | CTTGATCTCTTAGCTG | 51 | 736 |
| 1245727 | 1462 | 1477 | 21277 | 21292 | GCTAGGGAAATCTTTC | 66 | 737 |
| 1245753 | 1508 | 1523 | 21323 | 21338 | GTCCAGAATAGAGTTG | 60 | 738 |
| 1245779 | 1567 | 1582 | 21382 | 21397 | TAGAGGGTCCACTTTT | 36 | 739 |
| 1245805 | 1626 | 1641 | 21441 | 21456 | AAATAGAGTCGGTCAC | 59 | 740 |
| 1245831 | 1729 | 1744 | 21544 | 21559 | AGCCTAAAATTGTCTA | 53 | 741 |
| 1245857 | 1781 | 1796 | 21596 | 21611 | TCTTATGTAATAGCCA | 77 | 742 |
| 1245883 | 2186 | 2201 | 22001 | 22016 | GATGTAGTGGGAGTCG | 67 | 743 |
| 1245909 | 2257 | 2272 | 22072 | 22087 | AAACAAGAGGATAGTC | 48 | 744 |
| 1245935 | N/A | N/A | 3492 | 3507 | TATACAGACTAAGGGA | 24 | 745 |
| 1245961 | N/A | N/A | 3629 | 3644 | GATAAATATGTGCTTG | 68 | 746 |
| 1245987 | N/A | N/A | 4139 | 4154 | TCTCAAGGAGTACTTC | 80 | 747 |

TABLE 10-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246013 | N/A | N/A | 4645 | 4660 | TTTAATACGACTTCCT | 72 | 748 |
| 1246039 | N/A | N/A | 5156 | 5171 | CAAACTGCTACTGTGT | 57 | 749 |
| 1246065 | N/A | N/A | 5659 | 5674 | ATAAGTTACCAGAGCA | 91 | 48 |
| 1246091 | N/A | N/A | 5875 | 5890 | TAGGCTAAACCCTGGA | 64 | 750 |
| 1246117 | N/A | N/A | 6134 | 6149 | CTCTAATGTTTCTTGA | 53 | 751 |
| 1246143 | N/A | N/A | 6422 | 6437 | TAAACTGTATGCCTCT | 49 | 752 |
| 1246169 | N/A | N/A | 6622 | 6637 | CAGTAGGCAGTTTCTC | 72 | 753 |
| 1246195 | N/A | N/A | 7776 | 7791 | TTCAGTTAGCAGCTAA | 72 | 754 |
| 1246221 | N/A | N/A | 7979 | 7994 | CTGCAAAGTTAATAGG | 57 | 755 |
| 1246247 | N/A | N/A | 8529 | 8544 | GTTTATCAGTAAAGTG | 64 | 756 |
| 1246273 | N/A | N/A | 8940 | 8955 | TTAAGAGAAGGTGCAC | 38 | 757 |
| 1246299 | N/A | N/A | 9146 | 9161 | GCCAAGCTTTGTGTCA | 64 | 758 |
| 1246325 | N/A | N/A | 9413 | 9428 | TCTGTATAGCTGCATT | 47 | 759 |
| 1246351 | N/A | N/A | 9603 | 9618 | CACATATGTGAAGAGC | 71 | 760 |
| 1246377 | N/A | N/A | 9780 | 9795 | ATAGAACTAGAACTCC | 22 | 761 |
| 1246403 | N/A | N/A | 10058 | 10073 | GATAATTTGGTGTCAT | 59 | 762 |
| 1246429 | N/A | N/A | 10385 | 10400 | TTAAGGATCATTGCAG | 14 | 763 |
| 1246455 | N/A | N/A | 10931 | 10946 | CATAAGGCCGATTCAT | 32 | 764 |
| 1246481 | N/A | N/A | 11482 | 11497 | GGAAAGGATATTTGGC | 58 | 765 |
| 1246507 | N/A | N/A | 11793 | 11808 | ACTCTATTGATTGGCT | 57 | 766 |
| 1246533 | N/A | N/A | 12178 | 12193 | TGATTTTGACCTTACC | 11 | 767 |
| 1246559 | N/A | N/A | 12487 | 12502 | TGACTAAGGAGCTAGA | 31 | 768 |
| 1246585 | N/A | N/A | 12685 | 12700 | ATTAAGCTTAGTATAT | 10 | 769 |
| 1246611 | N/A | N/A | 12810 | 12825 | AGCTAACTCAGGCTGT | 14 | 770 |
| 1246637 | N/A | N/A | 13738 | 13753 | GCATACTTATTAAGTA | 32 | 771 |
| 1246663 | N/A | N/A | 13917 | 13932 | TCCATTATCCTTACTC | 15 | 772 |
| 1246689 | N/A | N/A | 14090 | 14105 | TCTACATGGATCCAAC | 26 | 773 |
| 1246715 | N/A | N/A | 14280 | 14295 | TGTAAAGGCTGGGTGA | 26 | 774 |
| 1246741 | N/A | N/A | 14473 | 14488 | TATGACAACTGGAGGT | 14 | 775 |
| 1246767 | N/A | N/A | 15024 | 15039 | GTTGATAAAATAGGGT | 42 | 776 |
| 1246793 | N/A | N/A | 15354 | 15369 | AAGGAGTAGTGGAGCC | 38 | 777 |
| 1246819 | N/A | N/A | 15445 | 15460 | GTTATCAGAAACTTAT | 31 | 778 |
| 1246845 | N/A | N/A | 16219 | 16234 | TTATAGACTGGGTAGG | 51 | 779 |
| 1246871 | N/A | N/A | 17017 | 17032 | GTTTAGCAATTTAGCA | 50 | 780 |
| 1246897 | N/A | N/A | 17956 | 17971 | ATTTAGAAACTGCTCC | 21 | 781 |

TABLE 10-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246923 | N/A | N/A | 18521 | 18536 | GCTTAGTACCAAGACA | 62 | 782 |
| 1246949 | N/A | N/A | 18849 | 18864 | CCTTTTAACTACCCTC | 22 | 783 |
| 1246975 | N/A | N/A | 19533 | 19548 | AGGCTAAAATGGTCAT | 36 | 784 |
| 1247001 | N/A | N/A | 19736 | 19751 | CTAAAACTGAAGGTCT | 40 | 785 |
| 1247027 | N/A | N/A | 19936 | 19951 | TAGGAACATTCCCTCT | 24 | 786 |
| 1247053 | N/A | N/A | 20362 | 20377 | TCTAAATTATTGCCTG | 43 | 787 |
| 1247079 | N/A | N/A | 20485 | 20500 | ACTTCATAGTGGACTT | 61 | 788 |

TABLE 11

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245078 | 14 | 29 | 3108 | 3123 | TGTGTAGTCCTAGGGA | 50 | 789 |
| 1245104 | 72 | 87 | 3166 | 3181 | GGATTTCTAGGATGAT | 58 | 790 |
| 1245130 | 121 | 136 | 3215 | 3230 | TTCACCAACGACTCCA | 62 | 791 |
| 1245156 | 213 | 228 | 3307 | 3322 | CATAAGTAGTCTGCCT | 31 | 792 |
| 1245182 | 273 | 288 | N/A | N/A | CCTCCACACCGCGCTT | 16 | 793 |
| 1245208 | 320 | 335 | 7609 | 7624 | ATACGCATGCGCAGTG | 38 | 794 |
| 1245234 | 369 | 384 | 7658 | 7673 | CCTGATTTAGAGAGCG | 42 | 795 |
| 1245260 | 412 | 427 | 8806 | 8821 | GCATTATTCACCACGA | 59 | 796 |
| 1245286 | 442 | 457 | 8836 | 8851 | CTGAGAAGATCGGCTG | 37 | 797 |
| 1245312 | 486 | 501 | 8880 | 8895 | GGATGTTGACCTCAAA | 5 | 798 |
| 1245338 | 532 | 547 | 10418 | 10433 | TCCATCATCGATGGAA | 31 | 799 |
| 1245364 | 579 | 594 | 10465 | 10480 | CGTGGCCGCACACTGA | 42 | 800 |
| 1245390 | 645 | 660 | 12063 | 12078 | GACCTCTGTGAAAGCC | 46 | 801 |
| 1245416 | 715 | 730 | 12133 | 12148 | TTCACAAAAACTGGGC | 37 | 802 |
| 1245442 | 769 | 784 | 15650 | 15665 | TCTGTCTCCAATACAG | 13 | 803 |
| 1245468 | 802 | 817 | 15683 | 15698 | AGTATTCCATCTATCA | 62 | 804 |
| 1245494* | 891 | 906 | 20706 | 20721 | AAATCGCTGAGGCGCG | 89 | 805 |
| 1245520* | 933 | 948 | 20748 | 20763 | GGCCAACCACTGCTTC | 93 | 806 |
| 1245546* | 984 | 999 | 20799 | 20814 | ATGCATACATCTCTGG | 53 | 807 |
| 1245572 | 1025 | 1040 | 20840 | 20855 | AAGCTTTGCAGCATTG | 59 | 808 |
| 1245598 | 1112 | 1127 | 20927 | 20942 | AGACAGGTAATTAATC | 29 | 809 |
| 1245624 | 1270 | 1285 | 21085 | 21100 | CTTTTAGGGAGGTAGC | 62 | 810 |

TABLE 11-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245650 | 1324 | 1339 | 21139 | 21154 | GCTACTTGAACAGTCT | 66 | 811 |
| 1245676 | 1351 | 1366 | 21166 | 21181 | TTCTGTGGCATGGCTA | 78 | 812 |
| 1245702 | 1395 | 1410 | 21210 | 21225 | ACTTGATCTCTTAGCT | 59 | 813 |
| 1245728 | 1463 | 1478 | 21278 | 21293 | GGCTAGGGAAATCTTT | 57 | 814 |
| 1245754 | 1509 | 1524 | 21324 | 21339 | AGTCCAGAATAGAGTT | 58 | 815 |
| 1245780 | 1568 | 1583 | 21383 | 21398 | ATAGAGGGTCCACTTT | 21 | 816 |
| 1245806 | 1627 | 1642 | 21442 | 21457 | AAAATAGAGTCGGTCA | 71 | 817 |
| 1245832 | 1730 | 1745 | 21545 | 21560 | GAGCCTAAAATTGTCT | 49 | 818 |
| 1245858 | 1782 | 1797 | 21597 | 21612 | TTCTTATGTAATAGCC | 71 | 819 |
| 1245884 | 2187 | 2202 | 22002 | 22017 | TGATGTAGTGGGAGTC | 65 | 820 |
| 1245910 | 2349 | 2364 | 22164 | 22179 | CTACAAGAGGTTATTT | 31 | 821 |
| 1245936 | N/A | N/A | 3493 | 3508 | ATATACAGACTAAGGG | 24 | 822 |
| 1245962 | N/A | N/A | 3671 | 3686 | AAGTTATTATCCCCAC | 60 | 823 |
| 1245988 | N/A | N/A | 4220 | 4235 | AACTAAACATGACAGC | 72 | 824 |
| 1246014 | N/A | N/A | 4646 | 4661 | TTTTAATACGACTTCC | 57 | 825 |
| 1246040 | N/A | N/A | 5164 | 5179 | ATAAGAGCCAAACTGC | 49 | 826 |
| 1246066 | N/A | N/A | 5660 | 5675 | CATAAGTTACCAGAGC | 80 | 827 |
| 1246092 | N/A | N/A | 5878 | 5893 | CTGTAGGCTAAACCCT | 47 | 828 |
| 1246118 | N/A | N/A | 6135 | 6150 | GCTCTAATGTTTCTTG | 62 | 829 |
| 1246144 | N/A | N/A | 6423 | 6438 | GTAAACTGTATGCCTC | 74 | 830 |
| 1246170 | N/A | N/A | 6624 | 6639 | TACAGTAGGCAGTTTC | 60 | 831 |
| 1246196 | N/A | N/A | 7777 | 7792 | CTTCAGTTAGCAGCTA | 50 | 832 |
| 1246222 | N/A | N/A | 8039 | 8054 | ACTACATTAACACCAA | 46 | 833 |
| 1246248 | N/A | N/A | 8534 | 8549 | TGCAAGTTTATCAGTA | 70 | 834 |
| 1246274 | N/A | N/A | 8941 | 8956 | CTTAAGAGAAGGTGCA | 43 | 835 |
| 1246300 | N/A | N/A | 9188 | 9203 | CTTAACAAACCTCCAC | 3 | 836 |
| 1246326 | N/A | N/A | 9424 | 9439 | ATTATATGAGGTCTGT | 59 | 837 |
| 1246352 | N/A | N/A | 9604 | 9619 | TCACATATGTGAAGAG | 27 | 838 |
| 1246378 | N/A | N/A | 9781 | 9796 | CATAGAACTAGAACTC | 19 | 839 |
| 1246404 | N/A | N/A | 10059 | 10074 | TGATAATTTGGTGTCA | 3 | 840 |
| 1246430 | N/A | N/A | 10386 | 10401 | CTTAAGGATCATTGCA | 29 | 841 |
| 1246456 | N/A | N/A | 10971 | 10986 | GTAATCTTGAGGCAGG | 51 | 842 |
| 1246482 | N/A | N/A | 11511 | 11526 | TATTATGAGGATCTGG | 44 | 843 |
| 1246508 | N/A | N/A | 11853 | 11868 | AGCAGAATTGTGAACG | 67 | 844 |
| 1246534 | N/A | N/A | 12194 | 12209 | CATACCCATTCTAACT | 6 | 845 |

TABLE 11-continued

Inhibition of HSD17B13 RNA by 3-10-3 cEt
gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246560 | N/A | N/A | 12488 | 12503 | TTGACTAAGGAGCTAG | 20 | 846 |
| 1246586 | N/A | N/A | 12686 | 12701 | CATTAAGCTTAGTATA | 19 | 847 |
| 1246612 | N/A | N/A | 12813 | 12828 | CATAGCTAACTCAGGC | 29 | 848 |
| 1246638 | N/A | N/A | 13748 | 13763 | CTTACATATTGCATAC | 35 | 849 |
| 1246664 | N/A | N/A | 13951 | 13966 | CTAAGTTAGCCCCCAG | 15 | 850 |
| 1246690 | N/A | N/A | 14091 | 14106 | ATCTACATGGATCCAA | 12 | 851 |
| 1246716 | N/A | N/A | 14283 | 14298 | GAATGTAAAGGCTGGG | 42 | 852 |
| 1246742 | N/A | N/A | 14477 | 14492 | GGAGTATGACAACTGG | 28 | 853 |
| 1246768 | N/A | N/A | 15170 | 15185 | CGTTTAAATCAGAGCA | 54 | 854 |
| 1246794 | N/A | N/A | 15355 | 15370 | TAAGGAGTAGTGGAGC | 18 | 855 |
| 1246820 | N/A | N/A | 15492 | 15507 | ATTAATGCCACCCTAC | 6 | 856 |
| 1246846 | N/A | N/A | 16223 | 16238 | CTTTTTATAGACTGGG | 67 | 857 |
| 1246872 | N/A | N/A | 17019 | 17034 | AGGTTTAGCAATTTAG | 54 | 858 |
| 1246898 | N/A | N/A | 17985 | 18000 | ATAGTTATCTTCTCAC | 48 | 859 |
| 1246924 | N/A | N/A | 18585 | 18600 | TATTAATATGACTTGC | 25 | 860 |
| 1246950 | N/A | N/A | 18850 | 18865 | GCCTTTTAACTACCCT | 0 | 861 |
| 1246976 | N/A | N/A | 19534 | 19549 | TAGGCTAAAATGGTCA | 59 | 862 |
| 1247002 | N/A | N/A | 19739 | 19754 | GATCTAAAACTGAAGG | 44 | 863 |
| 1247028 | N/A | N/A | 19970 | 19985 | AATTTCATACAGTTCG | 66 | 864 |
| 1247054 | N/A | N/A | 20363 | 20378 | GTCTAAATTATTGCCT | 45 | 865 |
| 1247080 | N/A | N/A | 20489 | 20504 | CATAACTTCATAGTGG | 31 | 866 |

TABLE 12

Inhibition of HSD17B13 RNA by 3-10-3 cEt
gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245079 | 15 | 30 | 3109 | 3124 | TTGTGTAGTCCTAGGG | 64 | 867 |
| 1245105 | 75 | 90 | 3169 | 3184 | GAAGGATTTCTAGGAT | 71 | 868 |
| 1245131 | 122 | 137 | 3216 | 3231 | CTTCACCAACGACTCC | 8 | 869 |
| 1245157 | 214 | 229 | 3308 | 3323 | TCATAAGTAGTCTGCC | 62 | 870 |
| 1245183 | 274 | 289 | 7563 | 7578 | TCCTCCACACCGCGCT | 20 | 871 |
| 1245209 | 321 | 336 | 7610 | 7625 | CATACGCATGCGCAGT | 60 | 872 |
| 1245235 | 370 | 385 | 7659 | 7674 | ACCTGATTTAGAGAGC | 65 | 873 |
| 1245261 | 413 | 428 | 8807 | 8822 | AGCATTATTCACCACG | 53 | 874 |

TABLE 12-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245287 | 443 | 458 | 8837 | 8852 | GCTGAGAAGATCGGCT | 10 | 875 |
| 1245313 | 487 | 502 | 8881 | 8896 | AGGATGTTGACCTCAA | 4 | 876 |
| 1245339 | 533 | 548 | 10419 | 10434 | CTCCATCATCGATGGA | 0 | 877 |
| 1245365 | 593 | 608 | 10479 | 10494 | GTAAGGAATCCCTTCG | 22 | 878 |
| 1245391 | 646 | 661 | 12064 | 12079 | AGACCTCTGTGAAAGC | 50 | 879 |
| 1245417 | 723 | 738 | 12141 | 12156 | ACCCAGTATTCACAAA | 10 | 880 |
| 1245443 | 770 | 785 | 15651 | 15666 | ATCTGTCTCCAATACA | 55 | 881 |
| 1245469 | 803 | 818 | 15684 | 15699 | AAGTATTCCATCTATC | 52 | 882 |
| 1245495* | 892 | 907 | 20707 | 20722 | AAAATCGCTGAGGCGC | 97 | 883 |
| 1245521* | 934 | 949 | 20749 | 20764 | TGGCCAACCACTGCTT | 98 | 884 |
| 1245547* | 985 | 1000 | 20800 | 20815 | CATGCATACATCTCTG | 55 | 885 |
| 1245573 | 1029 | 1044 | 20844 | 20859 | AATAAAGCTTTGCAGC | 26 | 886 |
| 1245599 | 1117 | 1132 | 20932 | 20947 | CAGGAAGACAGGTAAT | 60 | 887 |
| 1245625 | 1271 | 1286 | 21086 | 21101 | ACTTTTAGGGAGGTAG | 20 | 888 |
| 1245651 | 1325 | 1340 | 21140 | 21155 | TGCTACTTGAACAGTC | 81 | 889 |
| 1245677 | 1353 | 1368 | 21168 | 21183 | TATTCTGTGGCATGGC | 71 | 890 |
| 1245703 | 1396 | 1411 | 21211 | 21226 | AACTTGATCTCTTAGC | 64 | 891 |
| 1245729 | 1464 | 1479 | 21279 | 21294 | AGGCTAGGGAAATCTT | 62 | 892 |
| 1245755 | 1510 | 1525 | 21325 | 21340 | AAGTCCAGAATAGAGT | 60 | 893 |
| 1245781 | 1569 | 1584 | 21384 | 21399 | TATAGAGGGTCCACTT | 17 | 894 |
| 1245807 | 1628 | 1643 | 21443 | 21458 | TAAAATAGAGTCGGTC | 81 | 895 |
| 1245833 | 1731 | 1746 | 21546 | 21561 | TGAGCCTAAAATTGTC | 30 | 896 |
| 1245841 | 1765 | 1780 | 21580 | 21595 | GTACAGTTCCTTTTCC | 57 | 38 |
| 1245859 | 1784 | 1799 | 21599 | 21614 | GTTTCTTATGTAATAG | 46 | 897 |
| 1245885 | 2188 | 2203 | 22003 | 22018 | TTGATGTAGTGGGAGT | 68 | 898 |
| 1245911 | 2350 | 2365 | 22165 | 22180 | ACTACAAGAGGTTATT | 46 | 899 |
| 1245937 | N/A | N/A | 3494 | 3509 | CATATACAGACTAAGG | 57 | 900 |
| 1245963 | N/A | N/A | 3672 | 3687 | TAAGTTATTATCCCCA | 70 | 901 |
| 1245989 | N/A | N/A | 4249 | 4264 | CTCTAAGTGTAAGAGA | 28 | 902 |
| 1246015 | N/A | N/A | 4647 | 4662 | TTTTTAATACGACTTC | 52 | 903 |
| 1246041 | N/A | N/A | 5165 | 5180 | CATAAGAGCCAAACTG | 27 | 904 |
| 1246065 | N/A | N/A | 5659 | 5674 | ATAAGTTACCAGAGCA | 90 | 48 |
| 1246067 | N/A | N/A | 5661 | 5676 | GCATAAGTTACCAGAG | 79 | 905 |
| 1246093 | N/A | N/A | 5889 | 5904 | GTATTTCGCTACTGTA | 76 | 906 |
| 1246119 | N/A | N/A | 6149 | 6164 | CCTAAGATAAAATTGC | 18 | 907 |

TABLE 12-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246145 | N/A | N/A | 6425 | 6440 | TGGTAAACTGTATGCC | 76 | 908 |
| 1246171 | N/A | N/A | 6625 | 6640 | GTACAGTAGGCAGTTT | 50 | 909 |
| 1246197 | N/A | N/A | 7782 | 7797 | AACTACTTCAGTTAGC | 53 | 910 |
| 1246223 | N/A | N/A | 8043 | 8058 | GAAGACTACATTAACA | 36 | 911 |
| 1246249 | N/A | N/A | 8562 | 8577 | AAATTTCAGTACCCAG | 46 | 912 |
| 1246275 | N/A | N/A | 8942 | 8957 | TCTTAAGAGAAGGTGC | 39 | 913 |
| 1246301 | N/A | N/A | 9189 | 9204 | CCTTAACAAACCTCCA | 27 | 914 |
| 1246327 | N/A | N/A | 9426 | 9441 | CAATTATATGAGGTCT | 36 | 915 |
| 1246353 | N/A | N/A | 9610 | 9625 | GCCAATTCACATATGT | 34 | 916 |
| 1246379 | N/A | N/A | 9887 | 9902 | TATATGTTGATGTTAC | 34 | 917 |
| 1246405 | N/A | N/A | 10060 | 10075 | ATGATAATTTGGTGTC | 55 | 918 |
| 1246431 | N/A | N/A | 10387 | 10402 | TCTTAAGGATCATTGC | 0 | 919 |
| 1246457 | N/A | N/A | 10973 | 10988 | TTGTAATCTTGAGGCA | 27 | 920 |
| 1246483 | N/A | N/A | 11512 | 11527 | TTATTATGAGGATCTG | 50 | 921 |
| 1246509 | N/A | N/A | 11854 | 11869 | AAGCAGAATTGTGAAC | 18 | 922 |
| 1246535 | N/A | N/A | 12201 | 12216 | CATACCACATACCCAT | 0 | 923 |
| 1246561 | N/A | N/A | 12489 | 12504 | CTTGACTAAGGAGCTA | 24 | 924 |
| 1246587 | N/A | N/A | 12687 | 12702 | TCATTAAGCTTAGTAT | 31 | 925 |
| 1246613 | N/A | N/A | 12814 | 12829 | ACATAGCTAACTCAGG | 38 | 926 |
| 1246639 | N/A | N/A | 13763 | 13778 | GTACTATAGTATTTAC | 27 | 927 |
| 1246665 | N/A | N/A | 13952 | 13967 | TCTAAGTTAGCCCCCA | 36 | 928 |
| 1246691 | N/A | N/A | 14092 | 14107 | CATCTACATGGATCCA | 63 | 929 |
| 1246717 | N/A | N/A | 14316 | 14331 | TTAAGATGTCCAGGCA | 35 | 930 |
| 1246743 | N/A | N/A | 14479 | 14494 | AAGGAGTATGACAACT | 28 | 931 |
| 1246769 | N/A | N/A | 15211 | 15226 | CATAAAGCTGGATTGT | 0 | 932 |
| 1246795 | N/A | N/A | 15356 | 15371 | GTAAGGAGTAGTGGAG | 37 | 933 |
| 1246821 | N/A | N/A | 15493 | 15508 | CATTAATGCCACCCTA | 8 | 934 |
| 1246847 | N/A | N/A | 16254 | 16269 | AGTAGATTTGGTAGAG | 67 | 935 |
| 1246873 | N/A | N/A | 17041 | 17056 | GCTTATCGAGTTTAGC | 17 | 936 |
| 1246899 | N/A | N/A | 17987 | 18002 | GTATAGTTATCTTCTC | 59 | 937 |
| 1246925 | N/A | N/A | 18662 | 18677 | ATACTATTCTCCAACT | 25 | 938 |
| 1246951 | N/A | N/A | 18871 | 18886 | ATAAGAAGAGAGCTCA | 14 | 939 |
| 1246977 | N/A | N/A | 19544 | 19559 | GTTTAGCTGATAGGCT | 47 | 940 |
| 1247003 | N/A | N/A | 19749 | 19764 | TATGAGTAAAGATCTA | 10 | 941 |
| 1247029 | N/A | N/A | 20004 | 20019 | GTAATCAGTTTTCCTC | 79 | 942 |

TABLE 12-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1247055 | N/A | N/A | 20373 | 20388 | GTAAGGTAAAGTCTAA | 37 | 943 |
| 1247081 | N/A | N/A | 20490 | 20505 | ACATAACTTCATAGTG | 27 | 944 |

TABLE 13

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245080 | 16 | 31 | 3110 | 3125 | CTTGTGTAGTCCTAGG | 71 | 945 |
| 1245106 | 91 | 106 | 3185 | 3200 | ATGGTGATCAGAAGCA | 85 | 946 |
| 1245132 | 123 | 138 | 3217 | 3232 | ACTTCACCAACGACTC | 15 | 947 |
| 1245158 | 215 | 230 | 3309 | 3324 | TTCATAAGTAGTCTGC | 64 | 948 |
| 1245184 | 275 | 290 | 7564 | 7579 | TTCCTCCACACCGCGC | 47 | 949 |
| 1245210 | 322 | 337 | 7611 | 7626 | ACATACGCATGCGCAG | 20 | 950 |
| 1245236 | 371 | 386 | 7660 | 7675 | CACCTGATTTAGAGAG | 11 | 951 |
| 1245262 | 416 | 431 | 8810 | 8825 | CCCAGCATTATTCACC | 19 | 952 |
| 1245288 | 444 | 459 | 8838 | 8853 | TGCTGAGAAGATCGGC | 7 | 953 |
| 1245314 | 488 | 503 | 8882 | 8897 | TAGGATGTTGACCTCA | 19 | 954 |
| 1245340 | 534 | 549 | 10420 | 10435 | TCTCCATCATCGATGG | 24 | 955 |
| 1245366 | 594 | 609 | 10480 | 10495 | GGTAAGGAATCCCTTC | 43 | 956 |
| 1245392 | 649 | 664 | 12067 | 12082 | GTCAGACCTCTGTGAA | 34 | 957 |
| 1245418 | 724 | 739 | 12142 | 12157 | AACCCAGTATTCACAA | 0 | 958 |
| 1245444 | 771 | 786 | 15652 | 15667 | CATCTGTCTCCAATAC | 32 | 959 |
| 1245470 | 804 | 819 | 15685 | 15700 | TAAGTATTCCATCTAT | 31 | 960 |
| 1245496* | 893 | 908 | 20708 | 20723 | TAAAATCGCTGAGGCG | 87 | 961 |
| 1245522* | 935 | 950 | 20750 | 20765 | GTGGCCAACCACTGCT | 99 | 962 |
| 1245548* | 986 | 1001 | 20801 | 20816 | TCATGCATACATCTCT | 70 | 963 |
| 1245574 | 1055 | 1070 | 20870 | 20885 | ATATTATCAGGACTGA | 47 | 964 |
| 1245600 | 1136 | 1151 | 20951 | 20966 | CGTAAATATTCTTGAG | 61 | 965 |
| 1245626 | 1272 | 1287 | 21087 | 21102 | TACTTTTAGGGAGGTA | 28 | 966 |
| 1245652 | 1326 | 1341 | 21141 | 21156 | ATGCTACTTGAACAGT | 47 | 967 |
| 1245678 | 1354 | 1369 | 21169 | 21184 | ATATTCTGTGGCATGG | 69 | 968 |
| 1245704 | 1403 | 1418 | 21218 | 21233 | CTGCTGAAACTTGATC | 50 | 969 |
| 1245730 | 1465 | 1480 | 21280 | 21295 | GAGGCTAGGGAAATCT | 56 | 970 |

TABLE 13-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245756 | 1516 | 1531 | 21331 | 21346 | GTAATAAAGTCCAGAA | 66 | 971 |
| 1245782 | 1570 | 1585 | 21385 | 21400 | ATATAGAGGGTCCACT | 18 | 972 |
| 1245808 | 1629 | 1644 | 21444 | 21459 | TTAAAATAGAGTCGGT | 65 | 973 |
| 1245834 | 1732 | 1747 | 21547 | 21562 | TTGAGCCTAAAATTGT | 36 | 974 |
| 1245841 | 1765 | 1780 | 21580 | 21595 | GTACAGTTCCTTTTCC | 58 | 38 |
| 1245860 | 1792 | 1807 | 21607 | 21622 | GGTCCATTGTTTCTTA | 36 | 975 |
| 1245886 | 2189 | 2204 | 22004 | 22019 | CTTGATGTAGTGGGAG | 83 | 976 |
| 1245912 | 2351 | 2366 | 22166 | 22181 | AACTACAAGAGGTTAT | 57 | 977 |
| 1245938 | N/A | N/A | 3495 | 3510 | ACATATACAGACTAAG | 46 | 978 |
| 1245964 | N/A | N/A | 3673 | 3688 | CTAAGTTATTATCCCC | 70 | 979 |
| 1245990 | N/A | N/A | 4296 | 4311 | GTATAGTATTCTTCAC | 81 | 980 |
| 1246016 | N/A | N/A | 4649 | 4664 | CATTTTTAATACGACT | 57 | 981 |
| 1246042 | N/A | N/A | 5166 | 5181 | GCATAAGAGCCAAACT | 67 | 982 |
| 1246065 | N/A | N/A | 5659 | 5674 | ATAAGTTACCAGAGCA | 87 | 48 |
| 1246068 | N/A | N/A | 5662 | 5677 | AGCATAAGTTACCAGA | 87 | 983 |
| 1246094 | N/A | N/A | 5891 | 5906 | TTGTATTTCGCTACTG | 58 | 984 |
| 1246120 | N/A | N/A | 6170 | 6185 | CCTAAATTCAAAGACC | 64 | 985 |
| 1246146 | N/A | N/A | 6429 | 6444 | GTAATGGTAAACTGTA | 70 | 986 |
| 1246172 | N/A | N/A | 6737 | 6752 | TGAGATTACCCCTGGC | 53 | 987 |
| 1246198 | N/A | N/A | 7785 | 7800 | CATAACTACTTCAGTT | 3 | 988 |
| 1246224 | N/A | N/A | 8121 | 8136 | CTTAGTTCATTGTGAT | 69 | 989 |
| 1246250 | N/A | N/A | 8564 | 8579 | CTAAATTTCAGTACCC | 33 | 990 |
| 1246276 | N/A | N/A | 8943 | 8958 | ATCTTAAGAGAAGGTG | 43 | 991 |
| 1246302 | N/A | N/A | 9190 | 9205 | CCCTTAACAAACCTCC | 43 | 992 |
| 1246328 | N/A | N/A | 9429 | 9444 | AACCAATTATATGAGG | 38 | 993 |
| 1246354 | N/A | N/A | 9632 | 9647 | GTGTAGTTTGGTGGGC | 33 | 994 |
| 1246380 | N/A | N/A | 9908 | 9923 | CCTATTTGTAATATTG | 0 | 995 |
| 1246406 | N/A | N/A | 10062 | 10077 | TTATGATAATTTGGTG | 0 | 996 |
| 1246432 | N/A | N/A | 10388 | 10403 | ATCTTAAGGATCATTG | 7 | 997 |
| 1246458 | N/A | N/A | 10976 | 10991 | GCATTGTAATCTTGAG | 35 | 998 |
| 1246484 | N/A | N/A | 11513 | 11528 | TTTATTATGAGGATCT | 43 | 999 |
| 1246510 | N/A | N/A | 11856 | 11871 | TTAAGCAGAATTGTGA | 7 | 1000 |
| 1246536 | N/A | N/A | 12203 | 12218 | ATCATACCACATACCC | 45 | 1001 |
| 1246562 | N/A | N/A | 12501 | 12516 | GCAGAAATTCACCTTG | 74 | 1002 |
| 1246588 | N/A | N/A | 12690 | 12705 | GAATCATTAAGCTTAG | 63 | 1003 |

TABLE 13-continued

Inhibition of HSD17B13 RNA by 3-10-3 cEt
gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246614 | N/A | N/A | 12816 | 12831 | CCACATAGCTAACTCA | 53 | 1004 |
| 1246640 | N/A | N/A | 13768 | 13783 | CAATAGTACTATAGTA | 14 | 1005 |
| 1246666 | N/A | N/A | 13953 | 13968 | CTCTAAGTTAGCCCCC | 38 | 1006 |
| 1246692 | N/A | N/A | 14126 | 14141 | AATTACTCCGTTCTGC | 6 | 1007 |
| 1246718 | N/A | N/A | 14317 | 14332 | ATTAAGATGTCCAGGC | 31 | 1008 |
| 1246744 | N/A | N/A | 14480 | 14495 | CAAGGAGTATGACAAC | 6 | 1009 |
| 1246770 | N/A | N/A | 15213 | 15228 | TCCATAAAGCTGGATT | 13 | 1010 |
| 1246796 | N/A | N/A | 15358 | 15373 | TGGTAAGGAGTAGTGG | 34 | 1011 |
| 1246822 | N/A | N/A | 15494 | 15509 | GCATTAATGCCACCCT | 36 | 1012 |
| 1246848 | N/A | N/A | 16255 | 16270 | CAGTAGATTTGGTAGA | 49 | 1013 |
| 1246874 | N/A | N/A | 17042 | 17057 | AGCTTATCGAGTTTAG | 54 | 1014 |
| 1246900 | N/A | N/A | 17988 | 18003 | AGTATAGTTATCTTCT | 67 | 1015 |
| 1246926 | N/A | N/A | 18663 | 18678 | GATACTATTCTCCAAC | 44 | 1016 |
| 1246952 | N/A | N/A | 18872 | 18887 | GATAAGAAGAGAGCTC | 36 | 1017 |
| 1246978 | N/A | N/A | 19549 | 19564 | ATATTGTTTAGCTGAT | 14 | 1018 |
| 1247004 | N/A | N/A | 19751 | 19766 | GATATGAGTAAAGATC | 23 | 1019 |
| 1247030 | N/A | N/A | 20006 | 20021 | GAGTAATCAGTTTTCC | 65 | 1020 |
| 1247056 | N/A | N/A | 20374 | 20389 | AGTAAGGTAAAGTCTA | 55 | 1021 |
| 1247082 | N/A | N/A | 20492 | 20507 | TGACATAACTTCATAG | 51 | 1022 |

TABLE 14

Inhibition of HSD17B13 RNA by 3-10-3 cEt
gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245081 | 17 | 32 | 3111 | 3126 | CCTTGTGTAGTCCTAG | 67 | 1023 |
| 1245107 | 92 | 107 | 3186 | 3201 | GATGGTGATCAGAAGC | 52 | 1024 |
| 1245133 | 124 | 139 | 3218 | 3233 | AACTTCACCAACGACT | 0 | 1025 |
| 1245159 | 216 | 231 | 3310 | 3325 | ATTCATAAGTAGTCTG | 35 | 1026 |
| 1245185 | 276 | 291 | 7565 | 7580 | TTTCCTCCACACCGCG | 18 | 1027 |
| 1245211 | 323 | 338 | 7612 | 7627 | CACATACGCATGCGCA | 59 | 1028 |
| 1245237 | 372 | 387 | 7661 | 7676 | TCACCTGATTTAGAGA | 13 | 1029 |
| 1245263 | 418 | 433 | 8812 | 8827 | GTCCAGCATTATTCA | 21 | 1030 |
| 1245289 | 445 | 460 | 8839 | 8854 | GTGCTGAGAAGATCGG | 0 | 1031 |
| 1245315 | 489 | 504 | 8883 | 8898 | CTAGGATGTTGACCTC | 0 | 1032 |

TABLE 14-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245341 | 535 | 550 | 10421 | 10436 | CTCTCCATCATCGATG | 0 | 1033 |
| 1245367 | 595 | 610 | 10481 | 10496 | AGGTAAGGAATCCCTT | 0 | 1034 |
| 1245393 | 650 | 665 | 12068 | 12083 | TGTCAGACCTCTGTGA | 0 | 1035 |
| 1245419 | 725 | 740 | 12143 | 12158 | GAACCCAGTATTCACA | 0 | 1036 |
| 1245445 | 777 | 792 | 15658 | 15673 | CGACTTCATCTGTCTC | 19 | 1037 |
| 1245471 | 805 | 820 | 15686 | 15701 | GTAAGTATTCCATCTA | 45 | 1038 |
| 1245497* | 894 | 909 | 20709 | 20724 | TTAAAATCGCTGAGGC | 67 | 1039 |
| 1245523* | 936 | 951 | 20751 | 20766 | TGTGGCCAACCACTGC | 75 | 1040 |
| 1245549* | 987 | 1002 | 20802 | 20817 | ATCATGCATACATCTC | 62 | 1041 |
| 1245575 | 1075 | 1090 | 20890 | 20905 | GTGCCAAACCAATGTT | 43 | 1042 |
| 1245601 | 1150 | 1165 | 20965 | 20980 | CCTATGAAAAACTACG | 36 | 1043 |
| 1245627 | 1277 | 1292 | 21092 | 21107 | GTATTTACTTTTAGGG | 61 | 1044 |
| 1245653 | 1327 | 1342 | 21142 | 21157 | AATGCTACTTGAACAG | 54 | 1045 |
| 1245679 | 1355 | 1370 | 21170 | 21185 | GATATTCTGTGGCATG | 46 | 1046 |
| 1245705 | 1404 | 1419 | 21219 | 21234 | CCTGCTGAAACTTGAT | 19 | 1047 |
| 1245731 | 1466 | 1481 | 21281 | 21296 | AGAGGCTAGGGAAATC | 63 | 1048 |
| 1245757 | 1517 | 1532 | 21332 | 21347 | AGTAATAAAGTCCAGA | 43 | 1049 |
| 1245783 | 1571 | 1586 | 21386 | 21401 | AATATAGAGGGTCCAC | 7 | 1050 |
| 1245809 | 1630 | 1645 | 21445 | 21460 | TTTAAAATAGAGTCGG | 69 | 1051 |
| 1245835 | 1733 | 1748 | 21548 | 21563 | TTTGAGCCTAAAATTG | 26 | 1052 |
| 1245841 | 1765 | 1780 | 21580 | 21595 | GTACAGTTCCTTTTCC | 47 | 38 |
| 1245861 | 1793 | 1808 | 21608 | 21623 | GGGTCCATTGTTTCTT | 21 | 1053 |
| 1245887 | 2190 | 2205 | 22005 | 22020 | TCTTGATGTAGTGGGA | 44 | 1054 |
| 1245913 | 2352 | 2367 | 22167 | 22182 | TAACTACAAGAGGTTA | 22 | 1055 |
| 1245939 | N/A | N/A | 3507 | 3522 | AACTAACCTGACACAT | 20 | 1056 |
| 1245965 | N/A | N/A | 3674 | 3689 | CCTAAGTTATTATCCC | 18 | 1057 |
| 1245991 | N/A | N/A | 4360 | 4375 | ATACATCAACTCCTCT | 64 | 1058 |
| 1246017 | N/A | N/A | 4650 | 4665 | TCATTTTAATACGAC | 48 | 1059 |
| 1246043 | N/A | N/A | 5167 | 5182 | TGCATAAGAGCCAAAC | 56 | 1060 |
| 1246065 | N/A | N/A | 5659 | 5674 | ATAAGTTACCAGAGCA | 84 | 48 |
| 1246069 | N/A | N/A | 5663 | 5678 | GAGCATAAGTTACCAG | 61 | 1061 |
| 1246095 | N/A | N/A | 5916 | 5931 | CTTGAATGAGTGGTCT | 64 | 1062 |
| 1246121 | N/A | N/A | 6184 | 6199 | CAATTTACTTTCAGCC | 71 | 1063 |
| 1246147 | N/A | N/A | 6437 | 6452 | AACTAGTGGTAATGGT | 32 | 1064 |
| 1246173 | N/A | N/A | 6741 | 6756 | GCAATGAGATTACCCC | 83 | 1065 |

TABLE 14-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246199 | N/A | N/A | 7786 | 7801 | ACATAACTACTTCAGT | 28 | 1066 |
| 1246225 | N/A | N/A | 8122 | 8137 | GCTTAGTTCATTGTGA | 45 | 1067 |
| 1246251 | N/A | N/A | 8587 | 8602 | GGGATAAACTGTTCTT | 47 | 1068 |
| 1246277 | N/A | N/A | 8944 | 8959 | TATCTTAAGAGAAGGT | 29 | 1069 |
| 1246303 | N/A | N/A | 9191 | 9206 | ACCCTTAACAAACCTC | 36 | 1070 |
| 1246329 | N/A | N/A | 9430 | 9445 | TAACCAATTATATGAG | 0 | 1071 |
| 1246355 | N/A | N/A | 9636 | 9651 | CTCCGTGTAGTTTGGT | 28 | 1072 |
| 1246381 | N/A | N/A | 9922 | 9937 | GAATTCACTATCTCCC | 38 | 1073 |
| 1246407 | N/A | N/A | 10063 | 10078 | CTTATGATAATTTGGT | 2 | 1074 |
| 1246433 | N/A | N/A | 10389 | 10404 | GATCTTAAGGATCATT | 0 | 1075 |
| 1246459 | N/A | N/A | 11000 | 11015 | TAAATCCAAATCACTC | 39 | 1076 |
| 1246485 | N/A | N/A | 11514 | 11529 | TTTTATTATGAGGATC | 18 | 1077 |
| 1246511 | N/A | N/A | 11857 | 11872 | ATTAAGCAGAATTGTG | 8 | 1078 |
| 1246537 | N/A | N/A | 12205 | 12220 | TTATCATACCACATAC | 19 | 1079 |
| 1246563 | N/A | N/A | 12512 | 12527 | CAAGAGTTCTTGCAGA | 17 | 1080 |
| 1246589 | N/A | N/A | 12692 | 12707 | TCGAATCATTAAGCTT | 34 | 1081 |
| 1246615 | N/A | N/A | 12817 | 12832 | ACCACATAGCTAACTC | 50 | 1082 |
| 1246641 | N/A | N/A | 13769 | 13784 | GCAATAGTACTATAGT | 39 | 1083 |
| 1246667 | N/A | N/A | 13954 | 13969 | CCTCTAAGTTAGCCCC | 97 | 1084 |
| 1246693 | N/A | N/A | 14127 | 14142 | AAATTACTCCGTTCTG | 28 | 1085 |
| 1246719 | N/A | N/A | 14321 | 14336 | TCAAATTAAGATGTCC | 6 | 1086 |
| 1246745 | N/A | N/A | 14499 | 14514 | TGAGAATTTAAGAGGG | 25 | 1087 |
| 1246771 | N/A | N/A | 15217 | 15232 | GTATTCCATAAAGCTG | 10 | 1088 |
| 1246797 | N/A | N/A | 15359 | 15374 | ATGGTAAGGAGTAGTG | 17 | 1089 |
| 1246823 | N/A | N/A | 15495 | 15510 | TGCATTAATGCCACCC | 22 | 1090 |
| 1246849 | N/A | N/A | 16257 | 16272 | GACAGTAGATTTGGTA | 34 | 1091 |
| 1246875 | N/A | N/A | 17043 | 17058 | AAGCTTATCGAGTTTA | 26 | 1092 |
| 1246901 | N/A | N/A | 17989 | 18004 | TAGTATAGTTATCTTC | 28 | 1093 |
| 1246927 | N/A | N/A | 18666 | 18681 | TGGGATACTATTCTCC | 18 | 1094 |
| 1246953 | N/A | N/A | 18873 | 18888 | GGATAAGAAGAGAGCT | 46 | 1095 |
| 1246979 | N/A | N/A | 19550 | 19565 | GATATTGTTTAGCTGA | 59 | 1096 |
| 1247005 | N/A | N/A | 19753 | 19768 | CTGATATGAGTAAAGA | 21 | 1097 |
| 1247031 | N/A | N/A | 20008 | 20023 | GAGAGTAATCAGTTTT | 27 | 1098 |
| 1247057 | N/A | N/A | 20375 | 20390 | AAGTAAGGTAAAGTCT | 20 | 1099 |
| 1247083 | N/A | N/A | 20571 | 20586 | TTTAACTTTCCTCCGT | 16 | 1100 |

TABLE 15

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245082 | 18 | 33 | 3112 | 3127 | TCCTTGTGTAGTCCTA | 61 | 1101 |
| 1245108 | 93 | 108 | 3187 | 3202 | TGATGGTGATCAGAAG | 0 | 1102 |
| 1245134 | 125 | 140 | 3219 | 3234 | AAACTTCACCAACGAC | 27 | 1103 |
| 1245160 | 217 | 232 | 3311 | 3326 | AATTCATAAGTAGTCT | 28 | 1104 |
| 1245186 | 277 | 292 | 7566 | 7581 | GTTTCCTCCACACCGC | 45 | 1105 |
| 1245212 | 324 | 339 | 7613 | 7628 | CCACATACGCATGCGC | 68 | 1106 |
| 1245238 | 373 | 388 | N/A | N/A | TTCACCTGATTTAGAG | 9 | 1107 |
| 1245264 | 419 | 434 | 8813 | 8828 | TGTCCCAGCATTATTC | 31 | 1108 |
| 1245290 | 446 | 461 | 8840 | 8855 | GGTGCTGAGAAGATCG | 33 | 1109 |
| 1245316 | 490 | 505 | 8884 | 8899 | CCTAGGATGTTGACCT | 3 | 1110 |
| 1245342 | 536 | 551 | 10422 | 10437 | TCTCTCCATCATCGAT | 24 | 1111 |
| 1245368 | 596 | 611 | 10482 | 10497 | GAGGTAAGGAATCCCT | 27 | 1112 |
| 1245394 | 651 | 666 | 12069 | 12084 | ATGTCAGACCTCTGTG | 19 | 1113 |
| 1245420 | 726 | 741 | 12144 | 12159 | TGAACCCAGTATTCAC | 10 | 1114 |
| 1245446 | 778 | 793 | 15659 | 15674 | ACGACTTCATCTGTCT | 8 | 1115 |
| 1245472 | 806 | 821 | 15687 | 15702 | GGTAAGTATTCCATCT | 12 | 1116 |
| 1245498* | 895 | 910 | 20710 | 20725 | TTTAAAATCGCTGAGG | 24 | 1117 |
| 1245524* | 937 | 952 | 20752 | 20767 | TTGTGGCCAACCACTG | 83 | 1118 |
| 1245550* | 988 | 1003 | 20803 | 20818 | TATCATGCATACATCT | 45 | 1119 |
| 1245576 | 1076 | 1091 | 20891 | 20906 | AGTGCCAAACCAATGT | 62 | 1120 |
| 1245602 | 1154 | 1169 | 20969 | 20984 | CAGACCTATGAAAAAC | 26 | 1121 |
| 1245628 | 1296 | 1311 | 21111 | 21126 | GTGTAAATAAGTTCTC | 61 | 1122 |
| 1245654 | 1328 | 1343 | 21143 | 21158 | GAATGCTACTTGAACA | 44 | 1123 |
| 1245680 | 1356 | 1371 | 21171 | 21186 | TGATATTCTGTGGCAT | 69 | 1124 |
| 1245706 | 1405 | 1420 | 21220 | 21235 | GCCTGCTGAAACTTGA | 18 | 1125 |
| 1245732 | 1483 | 1498 | 21298 | 21313 | GGGCTAATGAAAAAGG | 14 | 1126 |
| 1245758 | 1520 | 1535 | 21335 | 21350 | TCAAGTAATAAAGTCC | 49 | 1127 |
| 1245784 | 1572 | 1587 | 21387 | 21402 | AAATATAGAGGGTCCA | 0 | 1128 |
| 1245810 | 1631 | 1646 | 21446 | 21461 | ATTTAAAATAGAGTCG | 24 | 1129 |
| 1245836 | 1738 | 1753 | 21553 | 21568 | TAATTTTTGAGCCTAA | 41 | 1130 |
| 1245841 | 1765 | 1780 | 21580 | 21595 | GTACAGTTCCTTTTCC | 55 | 38 |
| 1245862 | 1794 | 1809 | 21609 | 21624 | TGGGTCCATTGTTTCT | 35 | 1131 |
| 1245888 | 2191 | 2206 | 22006 | 22021 | GTCTTGATGTAGTGGG | 67 | 1132 |
| 1245914 | 2353 | 2368 | 22168 | 22183 | ATAACTACAAGAGGTT | 64 | 1133 |
| 1245940 | N/A | N/A | 3508 | 3523 | TAACTAACCTGACACA | 57 | 1134 |
| 1245966 | N/A | N/A | 3675 | 3690 | CCCTAAGTTATTATCC | 25 | 1135 |

TABLE 15-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245992 | N/A | N/A | 4361 | 4376 | TATACATCAACTCCTC | 39 | 1136 |
| 1246018 | N/A | N/A | 4652 | 4667 | AGTCATTTTAATACG | 13 | 1137 |
| 1246044 | N/A | N/A | 5168 | 5183 | TTGCATAAGAGCCAAA | 46 | 1138 |
| 1246065 | N/A | N/A | 5659 | 5674 | ATAAGTTACCAGAGCA | 75 | 48 |
| 1246070 | N/A | N/A | 5736 | 5751 | TAGTTGGTAGCTTGCT | 66 | 1139 |
| 1246096 | N/A | N/A | 5918 | 5933 | ACCTTGAATGAGTGGT | 26 | 1140 |
| 1246122 | N/A | N/A | 6185 | 6200 | GCAATTTACTTTCAGC | 66 | 1141 |
| 1246148 | N/A | N/A | 6441 | 6456 | TCTAAACTAGTGGTAA | 24 | 1142 |
| 1246174 | N/A | N/A | 6743 | 6758 | TTGCAATGAGATTACC | 29 | 1143 |
| 1246200 | N/A | N/A | 7787 | 7802 | GACATAACTACTTCAG | 66 | 1144 |
| 1246226 | N/A | N/A | 8133 | 8148 | TTTGTTAGAGTGCTTA | 80 | 1145 |
| 1246252 | N/A | N/A | 8596 | 8611 | CATAAAGGTGGGATAA | 23 | 1146 |
| 1246278 | N/A | N/A | 8945 | 8960 | GTATCTTAAGAGAAGG | 30 | 1147 |
| 1246304 | N/A | N/A | 9208 | 9223 | AAAGATGTACACTGAC | 57 | 1148 |
| 1246330 | N/A | N/A | 9431 | 9446 | CTAACCAATTATATGA | 21 | 1149 |
| 1246356 | N/A | N/A | 9648 | 9663 | AATGTATGAGGTCTCC | 65 | 1150 |
| 1246382 | N/A | N/A | 9926 | 9941 | GATTGAATTCACTATC | 0 | 1151 |
| 1246408 | N/A | N/A | 10064 | 10079 | CCTTATGATAATTTGG | 29 | 1152 |
| 1246434 | N/A | N/A | 10390 | 10405 | TGATCTTAAGGATCAT | 0 | 1153 |
| 1246460 | N/A | N/A | 11030 | 11045 | CATTCTAAACTACTAT | 11 | 1154 |
| 1246486 | N/A | N/A | 11542 | 11557 | GACAATGGTTGCCACT | 63 | 1155 |
| 1246512 | N/A | N/A | 11858 | 11873 | GATTAAGCAGAATTGT | 37 | 1156 |
| 1246538 | N/A | N/A | 12209 | 12224 | CAATTTATCATACCAC | 37 | 1157 |
| 1246564 | N/A | N/A | 12513 | 12528 | ACAAGAGTTCTTGCAG | 29 | 1158 |
| 1246590 | N/A | N/A | 12693 | 12708 | TTCGAATCATTAAGCT | 63 | 1159 |
| 1246616 | N/A | N/A | 12862 | 12877 | CACCATGAAGGACTCC | 48 | 1160 |
| 1246642 | N/A | N/A | 13770 | 13785 | TGCAATAGTACTATAG | 24 | 1161 |
| 1246668 | N/A | N/A | 13975 | 13990 | ATTTAGCATTGCCTGT | 10 | 1162 |
| 1246694 | N/A | N/A | 14128 | 14143 | TAAATTACTCCGTTCT | 36 | 1163 |
| 1246720 | N/A | N/A | 14362 | 14377 | GTGCAAGATGATGACA | 19 | 1164 |
| 1246746 | N/A | N/A | 14541 | 14556 | GTATTTGAGATTCACC | 41 | 1165 |
| 1246772 | N/A | N/A | 15244 | 15259 | GCTAAGTATACTTTCT | 37 | 1166 |
| 1246798 | N/A | N/A | 15360 | 15375 | GATGGTAAGGAGTAGT | 28 | 1167 |
| 1246824 | N/A | N/A | 15496 | 15511 | CTGCATTAATGCCACC | 67 | 1168 |
| 1246850 | N/A | N/A | 16272 | 16287 | CAAAGTTTGGGCAGAG | 44 | 1169 |

TABLE 15-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246876 | N/A | N/A | 17046 | 17061 | AAAAAGCTTATCGAGT | 8 | 1170 |
| 1246902 | N/A | N/A | 17991 | 18006 | GTTAGTATAGTTATCT | 66 | 1171 |
| 1246928 | N/A | N/A | 18671 | 18686 | TTTACTGGGATACTAT | 25 | 1172 |
| 1246954 | N/A | N/A | 18901 | 18916 | AGGGAAGATCTGGCTG | 4 | 1173 |
| 1246980 | N/A | N/A | 19563 | 19578 | AGCTATTGTCTTTGAT | 39 | 1174 |
| 1247006 | N/A | N/A | 19760 | 19775 | CTCTTATCTGATATGA | 7 | 1175 |
| 1247032 | N/A | N/A | 20037 | 20052 | GCATTAAAACTCTCAT | 35 | 1176 |
| 1247058 | N/A | N/A | 20376 | 20391 | CAAGTAAGGTAAAGTC | 33 | 1177 |
| 1247084 | N/A | N/A | 20572 | 20587 | GTTTAACTTTCCTCCG | 30 | 1178 |

TABLE 16

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245083 | 19 | 34 | 3113 | 3128 | GTCCTTGTGTAGTCCT | 62 | 1179 |
| 1245109 | 98 | 113 | 3192 | 3207 | GTAGATGATGGTGATC | 36 | 1180 |
| 1245135 | 126 | 141 | 3220 | 3235 | AAAACTTCACCAACGA | 29 | 1181 |
| 1245161 | 240 | 255 | 3334 | 3349 | CCAATATGCTCTGTCG | 65 | 1182 |
| 1245187 | 278 | 293 | 7567 | 7582 | AGTTTCCTCCACACCG | 28 | 1183 |
| 1245213 | 325 | 340 | 7614 | 7629 | ACCACATACGCATGCG | 45 | 1184 |
| 1245239 | 374 | 389 | N/A | N/A | CTTCACCTGATTTAGA | 7 | 1185 |
| 1245265 | 421 | 436 | 8815 | 8830 | ACTGTCCCAGCATTAT | 40 | 1186 |
| 1245291 | 452 | 467 | 8846 | 8861 | ATCCTTGGTGCTGAGA | 13 | 1187 |
| 1245317 | 491 | 506 | 8885 | 8900 | TCCTAGGATGTTGACC | 0 | 1188 |
| 1245343 | 537 | 552 | 10423 | 10438 | TTCTCTCCATCATCGA | 35 | 1189 |
| 1245369 | 597 | 612 | 10483 | 10498 | TGAGGTAAGGAATCCC | 2 | 1190 |
| 1245395 | 652 | 667 | 12070 | 12085 | GATGTCAGACCTCTGT | 6 | 1191 |
| 1245421 | 727 | 742 | 12145 | 12160 | GTGAACCCAGTATTCA | 1 | 1192 |
| 1245447 | 779 | 794 | 15660 | 15675 | TACGACTTCATCTGTC | 29 | 1193 |
| 1245473 | 807 | 822 | 15688 | 15703 | TGGTAAGTATTCCATC | 26 | 1194 |
| 1245499* | 896 | 911 | 20711 | 20726 | ATTTAAAATCGCTGAG | 30 | 1195 |
| 1245525* | 938 | 953 | 20753 | 20768 | TTTGTGGCCAACCACT | 88 | 1196 |
| 1245551* | 989 | 1004 | 20804 | 20819 | TTATCATGCATACATC | 52 | 1197 |
| 1245577 | 1077 | 1092 | 20892 | 20907 | TAGTGCCAAACCAATG | 46 | 1198 |

TABLE 16-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245603 | 1180 | 1195 | 20995 | 21010 | GTTTTTAAGAGGCATG | 63 | 1199 |
| 1245629 | 1298 | 1313 | 21113 | 21128 | CTGTGTAAATAAGTTC | 38 | 1200 |
| 1245655 | 1329 | 1344 | 21144 | 21159 | GGAATGCTACTTGAAC | 63 | 1201 |
| 1245681 | 1357 | 1372 | 21172 | 21187 | TTGATATTCTGTGGCA | 87 | 1202 |
| 1245707 | 1406 | 1421 | 21221 | 21236 | TGCCTGCTGAAACTTG | 31 | 1203 |
| 1245733 | 1488 | 1503 | 21303 | 21318 | GTTTTGGGCTAATGAA | 54 | 1204 |
| 1245759 | 1538 | 1553 | 21353 | 21368 | GTTATACAGAAGACAG | 54 | 1205 |
| 1245785 | 1573 | 1588 | 21388 | 21403 | GAAATATAGAGGGTCC | 22 | 1206 |
| 1245811 | 1654 | 1669 | 21469 | 21484 | GGGCTAGAACTTAAAA | 35 | 1207 |
| 1245837 | 1742 | 1757 | 21557 | 21572 | GCTTTAATTTTTGAGC | 26 | 1208 |
| 1245863 | 1795 | 1810 | 21610 | 21625 | TTGGGTCCATTGTTTC | 44 | 1209 |
| 1245889 | 2192 | 2207 | 22007 | 22022 | AGTCTTGATGTAGTGG | 63 | 1210 |
| 1245915 | 2354 | 2369 | 22169 | 22184 | TATAACTACAAGAGGT | 46 | 1211 |
| 1245941 | N/A | N/A | 3509 | 3524 | CTAACTAACCTGACAC | 23 | 1212 |
| 1245967 | N/A | N/A | 3703 | 3718 | TAATTTTCAGATCCCG | 75 | 1213 |
| 1245993 | N/A | N/A | 4362 | 4377 | ATATACATCAACTCCT | 43 | 1214 |
| 1246019 | N/A | N/A | 4991 | 5006 | GAATTTTTGAGGTTGG | 77 | 1215 |
| 1246045 | N/A | N/A | 5173 | 5188 | TTAGATTGCATAAGAG | 61 | 1216 |
| 1246071 | N/A | N/A | 5738 | 5753 | TTTAGTTGGTAGCTTG | 63 | 1217 |
| 1246097 | N/A | N/A | 5919 | 5934 | AACCTTGAATGAGTGG | 50 | 1218 |
| 1246123 | N/A | N/A | 6204 | 6219 | CATAGGACATGGAGAC | 69 | 1219 |
| 1246149 | N/A | N/A | 6443 | 6458 | ATTCTAAACTAGTGGT | 39 | 1220 |
| 1246175 | N/A | N/A | 6784 | 6799 | CTCCTTATTTGTTAGA | 26 | 1221 |
| 1246201 | N/A | N/A | 7788 | 7803 | TGACATAACTACTTCA | 22 | 1222 |
| 1246227 | N/A | N/A | 8137 | 8152 | AAAGTTTGTTAGAGTG | 75 | 1223 |
| 1246253 | N/A | N/A | 8597 | 8612 | TCATAAAGGTGGGATA | 40 | 1224 |
| 1246279 | N/A | N/A | 8959 | 8974 | GTTATAAGTTTCATGT | 21 | 1225 |
| 1246305 | N/A | N/A | 9215 | 9230 | GCATTGAAAAGATGTA | 0 | 1226 |
| 1246331 | N/A | N/A | 9476 | 9491 | TCTATACAAAGGCAGT | 53 | 1227 |
| 1246357 | N/A | N/A | 9649 | 9664 | TAATGTATGAGGTCTC | 51 | 1228 |
| 1246383 | N/A | N/A | 9928 | 9943 | ATGATTGAATTCACTA | 33 | 1229 |
| 1246409 | N/A | N/A | 10112 | 10127 | TAAACAATATTAAGGG | 0 | 1230 |
| 1246435 | N/A | N/A | 10494 | 10509 | CCAATATGGGATGAGG | 60 | 1231 |
| 1246461 | N/A | N/A | 11074 | 11089 | TTACAACCTGGTTTCA | 25 | 1232 |
| 1246487 | N/A | N/A | 11543 | 11558 | TGACAATGGTTGCCAC | 40 | 1233 |
| 1246513 | N/A | N/A | 11859 | 11874 | TGATTAAGCAGAATTG | 57 | 1234 |

TABLE 16-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246539 | N/A | N/A | 12210 | 12225 | TCAATTTATCATACCA | 26 | 1235 |
| 1246565 | N/A | N/A | 12514 | 12529 | GACAAGAGTTCTTGCA | 22 | 1236 |
| 1246591 | N/A | N/A | 12694 | 12709 | TTTCGAATCATTAAGC | 30 | 1237 |
| 1246617 | N/A | N/A | 12875 | 12890 | ACCTATGGTCTAACAC | 14 | 1238 |
| 1246643 | N/A | N/A | 13771 | 13786 | TTGCAATAGTACTATA | 3 | 1239 |
| 1246669 | N/A | N/A | 13976 | 13991 | TATTTAGCATTGCCTG | 12 | 1240 |
| 1246695 | N/A | N/A | 14129 | 14144 | CTAAATTACTCCGTTC | 20 | 1241 |
| 1246721 | N/A | N/A | 14377 | 14392 | TAGAATTGTCTGTTAG | 9 | 1242 |
| 1246747 | N/A | N/A | 14542 | 14557 | CGTATTTGAGATTCAC | 59 | 1243 |
| 1246773 | N/A | N/A | 15245 | 15260 | AGCTAAGTATACTTTC | 18 | 1244 |
| 1246799 | N/A | N/A | 15361 | 15376 | AGATGGTAAGGAGTAG | 26 | 1245 |
| 1246825 | N/A | N/A | 15511 | 15526 | ATATTCCAGGATTTGC | 26 | 1246 |
| 1246851 | N/A | N/A | 16273 | 16288 | GCAAAGTTTGGGCAGA | 50 | 1247 |
| 1246877 | N/A | N/A | 17047 | 17062 | AAAAAGCTTATCGAG | 7 | 1248 |
| 1246903 | N/A | N/A | 17992 | 18007 | AGTTAGTATAGTTATC | 74 | 1249 |
| 1246929 | N/A | N/A | 18695 | 18710 | AAAGACTTTGAGACTC | 68 | 1250 |
| 1246955 | N/A | N/A | 18925 | 18940 | GAAAGATGGAATGAGC | 54 | 1251 |
| 1246981 | N/A | N/A | 19588 | 19603 | AGGTAAACTAAAGTAC | 6 | 1252 |
| 1247007 | N/A | N/A | 19778 | 19793 | CATACCACTCTTCTCA | 24 | 1253 |
| 1247033 | N/A | N/A | 20039 | 20054 | ATGCATTAAAACTCTC | 12 | 1254 |
| 1247059 | N/A | N/A | 20377 | 20392 | ACAAGTAAGGTAAAGT | 38 | 1255 |
| 1247085 | N/A | N/A | 20589 | 20604 | AGAGTTATCTGGTTTG | 56 | 1256 |

TABLE 17

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245084 | 20 | 35 | 3114 | 3129 | AGTCCTTGTGTAGTCC | 64 | 1257 |
| 1245110 | 100 | 115 | 3194 | 3209 | GAGTAGATGATGGTGA | 28 | 1258 |
| 1245136 | 127 | 142 | 3221 | 3236 | AAAAACTTCACCAACG | 8 | 1259 |
| 1245162 | 241 | 256 | 3335 | 3350 | ACCAATATGCTCTGTC | 67 | 1260 |
| 1245188 | 289 | 304 | 7578 | 7593 | CACTCAGCTGCAGTTT | 13 | 1261 |
| 1245214 | 326 | 341 | 7615 | 7630 | TACCACATACGCATGC | 33 | 1262 |
| 1245240 | 375 | 390 | N/A | N/A | TCTTCACCTGATTTAG | 24 | 1263 |
| 1245266 | 422 | 437 | 8816 | 8831 | TACTGTCCCAGCATTA | 21 | 1264 |

TABLE 17-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245292 | 453 | 468 | 8847 | 8862 | CATCCTTGGTGCTGAG | 12 | 1265 |
| 1245318 | 492 | 507 | 8886 | 8901 | GTCCTAGGATGTTGAC | 1 | 1266 |
| 1245344 | 538 | 553 | 10424 | 10439 | TTTCTCTCCATCATCG | 27 | 1267 |
| 1245370 | 598 | 613 | 10484 | 10499 | ATGAGGTAAGGAATCC | 0 | 1268 |
| 1245396 | 654 | 669 | 12072 | 12087 | CTGATGTCAGACCTCT | 35 | 1269 |
| 1245422 | 728 | 743 | 12146 | 12161 | GGTGAACCCAGTATTC | 7 | 1270 |
| 1245448 | 780 | 795 | 15661 | 15676 | TTACGACTTCATCTGT | 36 | 1271 |
| 1245474 | 810 | 825 | 15691 | 15706 | TATTGGTAAGTATTCC | 67 | 1272 |
| 1245500* | 897 | 912 | 20712 | 20727 | GATTTAAAATCGCTGA | 49 | 1273 |
| 1245526* | 939 | 954 | 20754 | 20769 | TTTTGTGGCCAACCAC | 77 | 1274 |
| 1245552* | 992 | 1007 | 20807 | 20822 | TCATTATCATGCATAC | 67 | 1275 |
| 1245578 | 1078 | 1093 | 20893 | 20908 | CTAGTGCCAAACCAAT | 49 | 1276 |
| 1245604 | 1183 | 1198 | 20998 | 21013 | GAAGTTTTAAGAGGC | 64 | 1277 |
| 1245630 | 1299 | 1314 | 21114 | 21129 | CCTGTGTAAATAAGTT | 18 | 1278 |
| 1245656 | 1331 | 1346 | 21146 | 21161 | TTGGAATGCTACTTGA | 72 | 1279 |
| 1245682 | 1358 | 1373 | 21173 | 21188 | GTTGATATTCTGTGGC | 80 | 1280 |
| 1245708 | 1408 | 1423 | 21223 | 21238 | GCTGCCTGCTGAAACT | 38 | 1281 |
| 1245734 | 1489 | 1504 | 21304 | 21319 | CGTTTTGGGCTAATGA | 48 | 1282 |
| 1245760 | 1540 | 1555 | 21355 | 21370 | GAGTTATACAGAAGAC | 61 | 1283 |
| 1245786 | 1574 | 1589 | 21389 | 21404 | GGAAATATAGAGGGTC | 50 | 1284 |
| 1245812 | 1668 | 1683 | 21483 | 21498 | AAAAGGTTATCATGGG | 49 | 1285 |
| 1245838 | 1750 | 1765 | 21565 | 21580 | CTGTGTTAGCTTTAAT | 67 | 1286 |
| 1245841 | 1765 | 1780 | 21580 | 21595 | GTACAGTTCCTTTTCC | 61 | 38 |
| 1245864 | 1796 | 1811 | 21611 | 21626 | CTTGGGTCCATTGTTT | 44 | 1287 |
| 1245890 | 2193 | 2208 | 22008 | 22023 | TAGTCTTGATGTAGTG | 55 | 1288 |
| 1245916 | 2355 | 2370 | 22170 | 22185 | TTATAACTACAAGAGG | 68 | 1289 |
| 1245942 | N/A | N/A | 3511 | 3526 | ATCTAACTAACCTGAC | 0 | 1290 |
| 1245968 | N/A | N/A | 3704 | 3719 | GTAATTTTCAGATCCC | 82 | 1291 |
| 1245994 | N/A | N/A | 4363 | 4378 | TATATACATCAACTCC | 61 | 1292 |
| 1246020 | N/A | N/A | 5029 | 5044 | GCTTAAATGTTTAACC | 67 | 1293 |
| 1246046 | N/A | N/A | 5175 | 5190 | GTTTAGATTGCATAAG | 46 | 1294 |
| 1246065 | N/A | N/A | 5659 | 5674 | ATAAGTTACCAGAGCA | 88 | 48 |
| 1246072 | N/A | N/A | 5739 | 5754 | ATTTAGTTGGTAGCTT | 35 | 1295 |
| 1246098 | N/A | N/A | 5920 | 5935 | AAACCTTGAATGAGTG | 37 | 1296 |
| 1246124 | N/A | N/A | 6205 | 6220 | CCATAGGACATGGAGA | 68 | 1297 |
| 1246150 | N/A | N/A | 6444 | 6459 | AATTCTAAACTAGTGG | 31 | 1298 |

TABLE 17-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246176 | N/A | N/A | 6795<br>7104 | 6810<br>7119 | TAAAAATTGGCCTCCT | 29 | 1299 |
| 1246202 | N/A | N/A | 7804 | 7819 | ATATATCCTTCCTTGG | 20 | 1300 |
| 1246228 | N/A | N/A | 8139 | 8154 | GTAAAGTTTGTTAGAG | 54 | 1301 |
| 1246254 | N/A | N/A | 8598 | 8613 | GTCATAAAGGTGGGAT | 28 | 1302 |
| 1246280 | N/A | N/A | 8960 | 8975 | CGTTATAAGTTTCATG | 33 | 1303 |
| 1246306 | N/A | N/A | 9256 | 9271 | AATCATGGTGTGGAGG | 11 | 1304 |
| 1246332 | N/A | N/A | 9497 | 9512 | GGAAGATTAATCATAA | 32 | 1305 |
| 1246358 | N/A | N/A | 9650 | 9665 | CTAATGTATGAGGTCT | 46 | 1306 |
| 1246384 | N/A | N/A | 9937 | 9952 | TAATGAATCATGATTG | 2 | 1307 |
| 1246410 | N/A | N/A | 10145 | 10160 | GAATCAAATAGATCCT | 46 | 1308 |
| 1246436 | N/A | N/A | 10495 | 10510 | ACCAATATGGGATGAG | 24 | 1309 |
| 1246462 | N/A | N/A | 11078 | 11093 | ATAATTACAACCTGGT | 44 | 1310 |
| 1246488 | N/A | N/A | 11547<br>11572 | 11562<br>11587 | CTCTTGACAATGGTTG | 50 | 1311 |
| 1246514 | N/A | N/A | 11861 | 11876 | CATGATTAAGCAGAAT | 42 | 1312 |
| 1246540 | N/A | N/A | 12211 | 12226 | ATCAATTTATCATACC | 11 | 1313 |
| 1246566 | N/A | N/A | 12515 | 12530 | AGACAAGAGTTCTTGC | 30 | 1314 |
| 1246592 | N/A | N/A | 12701 | 12716 | AAATTGGTTTCGAATC | 32 | 1315 |
| 1246618 | N/A | N/A | 12889 | 12904 | CTTTAGTCAACAGTAC | 12 | 1316 |
| 1246644 | N/A | N/A | 13783 | 13798 | AACAATCAGGAGTTGC | 31 | 1317 |
| 1246670 | N/A | N/A | 13997 | 14012 | CTCTATAAAATCAATC | 0 | 1318 |
| 1246696 | N/A | N/A | 14130 | 14145 | TCTAAATTACTCCGTT | 15 | 1319 |
| 1246722 | N/A | N/A | 14378 | 14393 | GTAGAATTGTCTGTTA | 51 | 1320 |
| 1246748 | N/A | N/A | 14556 | 14571 | TCCGGTAAGAATTTCG | 63 | 1321 |
| 1246774 | N/A | N/A | 15246 | 15261 | TAGCTAAGTATACTTT | 10 | 1322 |
| 1246800 | N/A | N/A | 15364 | 15379 | ATTAGATGGTAAGGAG | 4 | 1323 |
| 1246826 | N/A | N/A | 15570 | 15585 | GTAAATGATGGCAGGA | 34 | 1324 |
| 1246852 | N/A | N/A | 16274 | 16289 | AGCAAAGTTTGGGCAG | 44 | 1325 |
| 1246878 | N/A | N/A | 17077 | 17092 | AAATTAGAGGCCCAGG | 43 | 1326 |
| 1246904 | N/A | N/A | 17994 | 18009 | GAAGTTAGTATAGTTA | 59 | 1327 |
| 1246930 | N/A | N/A | 18732 | 18747 | CTAGTTACAAACCACC | 43 | 1328 |
| 1246956 | N/A | N/A | 18958 | 18973 | AGATTTACTTCCTTGT | 41 | 1329 |
| 1246982 | N/A | N/A | 19590 | 19605 | TAAGGTAAACTAAAGT | 9 | 1330 |
| 1247008 | N/A | N/A | 19781 | 19796 | ATACATACCACTCTTC | 18 | 1331 |
| 1247034 | N/A | N/A | 20087 | 20102 | AGTAACTTTATTAACG | 12 | 1332 |

TABLE 17-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1247060 | N/A | N/A | 20381 | 20396 | AATCACAAGTAAGGTA | 52 | 1333 |
| 1247086 | N/A | N/A | 20599 | 20614 | GAATACGCTGAGAGTT | 11 | 1334 |

TABLE 18

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245085 | 21 | 36 | 3115 | 3130 | CAGTCCTTGTGTAGTC | 70 | 1335 |
| 1245111 | 101 | 116 | 3195 | 3210 | GGAGTAGATGATGGTG | 31 | 1336 |
| 1245137 | 154 | 169 | 3248 | 3263 | GCCACAGATTTTCTCC | 49 | 1337 |
| 1245163 | 242 | 257 | 3336 | 3351 | AACCAATATGCTCTGT | 51 | 1338 |
| 1245189 | 290 | 305 | 7579 | 7594 | GCACTCAGCTGCAGTT | 29 | 1339 |
| 1245215 | 327 | 342 | 7616 | 7631 | CTACCACATACGCATG | 25 | 1340 |
| 1245241 | 392 | 407 | 8786 | 8801 | TACATCACCCACTTCT | 37 | 1341 |
| 1245267 | 423 | 438 | 8817 | 8832 | ATACTGTCCCAGCATT | 32 | 1342 |
| 1245293 | 454 | 469 | 8848 | 8863 | TCATCCTTGGTGCTGA | 12 | 1343 |
| 1245319 | 493 | 508 | 8887 | 8902 | TGTCCTAGGATGTTGA | 41 | 1344 |
| 1245345 | 548 | 563 | 10434 | 10449 | GTGGCCATGATTTCTC | 40 | 1345 |
| 1245371 | 599 | 614 | 10485 | 10500 | GATGAGGTAAGGAATC | 0 | 1346 |
| 1245397 | 655 | 670 | 12073 | 12088 | TCTGATGTCAGACCTC | 42 | 1347 |
| 1245423 | 729 | 744 | 12147 | 12162 | TGGTGAACCCAGTATT | 0 | 1348 |
| 1245449 | 781 | 796 | 15662 | 15677 | CTTACGACTTCATCTG | 38 | 1349 |
| 1245475 | 812 | 827 | 15693 | 15708 | CTTATTGGTAAGTATT | 22 | 1350 |
| 1245501* | 898 | 913 | 20713 | 20728 | CGATTTAAAATCGCTG | 40 | 1351 |
| 1245527* | 940 | 955 | 20755 | 20770 | ATTTTGTGGCCAACCA | 59 | 1352 |
| 1245553 | 996 | 1011 | 20811 | 20826 | CATATCATTATCATGC | 66 | 1353 |
| 1245579 | 1079 | 1094 | 20894 | 20909 | GCTAGTGCCAAACCAA | 70 | 1354 |
| 1245605 | 1192 | 1207 | 21007 | 21022 | GTAAGCACAGAAGTTT | 55 | 1355 |
| 1245631 | 1300 | 1315 | 21115 | 21130 | CCCTGTGTAAATAAGT | 41 | 1356 |
| 1245657 | 1332 | 1347 | 21147 | 21162 | ATTGGAATGCTACTTG | 53 | 1357 |
| 1245683 | 1359 | 1374 | 21174 | 21189 | TGTTGATATTCTGTGG | 68 | 1358 |
| 1245709 | 1412 | 1427 | 21227 | 21242 | TAAAGCTGCCTGCTGA | 44 | 1359 |
| 1245735 | 1490 | 1505 | 21305 | 21320 | CCGTTTTGGGCTAATG | 58 | 1360 |
| 1245761 | 1545 | 1560 | 21360 | 21375 | CTTCAGAGTTATACAG | 35 | 1361 |
| 1245787 | 1575 | 1590 | 21390 | 21405 | AGGAAATATAGAGGGT | 54 | 1362 |

TABLE 18-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245813 | 1670 | 1685 | 21485 | 21500 | GAAAAAGGTTATCATG | 31 | 1363 |
| 1245839 | 1751 | 1766 | 21566 | 21581 | CCTGTGTTAGCTTTAA | 67 | 1364 |
| 1245841 | 1765 | 1780 | 21580 | 21595 | GTACAGTTCCTTTTCC | 58 | 38 |
| 1245865 | 1797 | 1812 | 21612 | 21627 | TCTTGGGTCCATTGTT | 60 | 1365 |
| 1245891 | 2194 | 2209 | 22009 | 22024 | TTAGTCTTGATGTAGT | 61 | 1366 |
| 1245917 | 2378 | 2393 | 22193 | 22208 | GTTTAGAAGTCAAACG | 0 | 1367 |
| 1245943 | N/A | N/A | 3512 | 3527 | CATCTAACTAACCTGA | 0 | 1368 |
| 1245969 | N/A | N/A | 3750 | 3765 | TAAAGGTTTCTGTTGC | 66 | 1369 |
| 1245995 | N/A | N/A | 4405 | 4420 | ATTCGAATTTCTTCAA | 65 | 1370 |
| 1246021 | N/A | N/A | 5042 | 5057 | GAATCATTCAGTAGCT | 65 | 1371 |
| 1246047 | N/A | N/A | 5177 | 5192 | CAGTTTAGATTGCATA | 60 | 1372 |
| 1246065 | N/A | N/A | 5659 | 5674 | ATAAGTTACCAGAGCA | 85 | 48 |
| 1246073 | N/A | N/A | 5740 | 5755 | GATTTAGTTGGTAGCT | 63 | 1373 |
| 1246099 | N/A | N/A | 5921 | 5936 | CAAACCTTGAATGAGT | 53 | 1374 |
| 1246125 | N/A | N/A | 6206 | 6221 | ACCATAGGACATGGAG | 62 | 1375 |
| 1246151 | N/A | N/A | 6445 | 6460 | TAATTCTAAACTAGTG | 11 | 1376 |
| 1246177 | N/A | N/A | 6796 | 6811 | ATAAAAATTGGCCTCC | 41 | 1377 |
| 1246203 | N/A | N/A | 7828 | 7843 | TGGATTACATACAAGA | 68 | 1378 |
| 1246229 | N/A | N/A | 8140 | 8155 | TGTAAAGTTTGTTAGA | 35 | 1379 |
| 1246255 | N/A | N/A | 8599 | 8614 | TGTCATAAAGGTGGGA | 48 | 1380 |
| 1246281 | N/A | N/A | 8961 | 8976 | CCGTTATAAGTTTCAT | 54 | 1381 |
| 1246307 | N/A | N/A | 9257 | 9272 | AAATCATGGTGTGGAG | 1 | 1382 |
| 1246333 | N/A | N/A | 9499 | 9514 | CTGGAAGATTAATCAT | 31 | 1383 |
| 1246359 | N/A | N/A | 9652 | 9667 | AGCTAATGTATGAGGT | 56 | 1384 |
| 1246385 | N/A | N/A | 9938 | 9953 | CTAATGAATCATGATT | 20 | 1385 |
| 1246411 | N/A | N/A | 10180 | 10195 | CTAATCTCAGTACTCC | 53 | 1386 |
| 1246437 | N/A | N/A | 10496 | 10511 | TACCAATATGGGATGA | 1 | 1387 |
| 1246463 | N/A | N/A | 11079 | 11094 | TATAATTACAACCTGG | 46 | 1388 |
| 1246489 | N/A | N/A | 11548 11573 | 11563 11588 | TCTCTTGACAATGGTT | 70 | 1389 |
| 1246515 | N/A | N/A | 11865 | 11880 | CTTACATGATTAAGCA | 44 | 1390 |
| 1246541 | N/A | N/A | 12238 | 12253 | GCCTAAACATTTCTCA | 2 | 1391 |
| 1246567 | N/A | N/A | 12516 | 12531 | GAGACAAGAGTTCTTG | 19 | 1392 |
| 1246593 | N/A | N/A | 12703 | 12718 | AAAAATTGGTTTCGAA | 13 | 1393 |
| 1246619 | N/A | N/A | 13551 | 13566 | CTCTCTAAAGGGCTGC | 55 | 1394 |
| 1246645 | N/A | N/A | 13813 | 13828 | TTTTATTGGGCCCAAT | 18 | 1395 |

TABLE 18-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246671 | N/A | N/A | 14007 | 14022 | ATCTAGCAACCTCTAT | 12 | 1396 |
| 1246697 | N/A | N/A | 14131 | 14146 | TTCTAAATTACTCCGT | 53 | 1397 |
| 1246723 | N/A | N/A | 14380 | 14395 | GTGTAGAATTGTCTGT | 42 | 1398 |
| 1246749 | N/A | N/A | 14557 | 14572 | TTCCGGTAAGAATTTC | 33 | 1399 |
| 1246775 | N/A | N/A | 15248 | 15263 | TATAGCTAAGTATACT | 23 | 1400 |
| 1246801 | N/A | N/A | 15365 | 15380 | CATTAGATGGTAAGGA | 32 | 1401 |
| 1246827 | N/A | N/A | 15571 | 15586 | AGTAAATGATGGCAGG | 40 | 1402 |
| 1246853 | N/A | N/A | 16287 | 16302 | TAGAATAGTCTTCAGC | 70 | 1403 |
| 1246879 | N/A | N/A | 17135 | 17150 | AATAGCCATGTAGCTA | 28 | 1404 |
| 1246905 | N/A | N/A | 17995 | 18010 | TGAAGTTAGTATAGTT | 43 | 1405 |
| 1246931 | N/A | N/A | 18733 | 18748 | CCTAGTTACAAACCAC | 51 | 1406 |
| 1246957 | N/A | N/A | 18962 | 18977 | TGCAAGATTTACTTCC | 45 | 1407 |
| 1246983 | N/A | N/A | 19598 | 19613 | CTCTATAATAAGGTAA | 0 | 1408 |
| 1247009 | N/A | N/A | 19782 | 19797 | GATACATACCACTCTT | 52 | 1409 |
| 1247035 | N/A | N/A | 20110 | 20125 | CAAGACATTCTAGCCT | 58 | 1410 |
| 1247061 | N/A | N/A | 20383 | 20398 | GTAATCACAAGTAAGG | 70 | 1411 |
| 1247087 | N/A | N/A | 20600 | 20615 | AGAATACGCTGAGAGT | 56 | 1412 |

TABLE 19

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245086 | 22 | 37 | 3116 | 3131 | TCAGTCCTTGTGTAGT | 72 | 1413 |
| 1245112 | 103 | 118 | 3197 | 3212 | TAGGAGTAGATGATGG | 15 | 1414 |
| 1245138 | 166 | 181 | 3260 | 3275 | ACAATCTCCCCAGCCA | 67 | 1415 |
| 1245164 | 243 | 258 | 3337 | 3352 | GAACCAATATGCTCTG | 61 | 1416 |
| 1245190 | 291 | 306 | 7580 | 7595 | GGCACTCAGCTGCAGT | 49 | 1417 |
| 1245216 | 328 | 343 | 7617 | 7632 | TCTACCACATACGCAT | 55 | 1418 |
| 1245242 | 393 | 408 | 8787 | 8802 | TTACATCACCCACTTC | 37 | 1419 |
| 1245268 | 424 | 439 | 8818 | 8833 | TATACTGTCCCAGCAT | 40 | 1420 |
| 1245294 | 456 | 471 | 8850 | 8865 | CTTCATCCTTGGTGCT | 30 | 1421 |
| 1245320 | 494 | 509 | 8888 | 8903 | ATGTCCTAGGATGTTG | 50 | 1422 |
| 1245346 | 551 | 566 | 10437 | 10452 | GATGTGGCCATGATTT | 9 | 1423 |
| 1245372 | 606 | 621 | 10492 | 10507 | AAATGGGATGAGGTA | 53 | 1424 |
| 1245398 | 656 | 671 | 12074 | 12089 | TTCTGATGTCAGACCT | 42 | 1425 |

TABLE 19-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245424 | 730 | 745 | 12148 | 12163 | TTGGTGAACCCAGTAT | 31 | 1426 |
| 1245450 | 782 | 797 | 15663 | 15678 | TCTTACGACTTCATCT | 34 | 1427 |
| 1245476 | 813 | 828 | 15694 | 15709 | TCTTATTGGTAAGTAT | 25 | 1428 |
| 1245502* | 899 | 914 | 20714 | 20729 | ACGATTTAAAATCGCT | 44 | 1429 |
| 1245528* | 941 | 956 | 20756 | 20771 | GATTTTGTGGCCAACC | 91 | 1430 |
| 1245554 | 1006 | 1021 | 20821 | 20836 | CGAAACTATTCATATC | 66 | 1431 |
| 1245580 | 1080 | 1095 | 20895 | 20910 | TGCTAGTGCCAAACCA | 78 | 1432 |
| 1245606 | 1198 | 1213 | 21013 | 21028 | GTTTATGTAAGCACAG | 67 | 1433 |
| 1245632 | 1301 | 1316 | 21116 | 21131 | TCCCTGTGTAAATAAG | 35 | 1434 |
| 1245658 | 1333 | 1348 | 21148 | 21163 | GATTGGAATGCTACTT | 58 | 1435 |
| 1245684 | 1364 | 1379 | 21179 | 21194 | GTTCTTGTTGATATTC | 84 | 1436 |
| 1245710 | 1414 | 1429 | 21229 | 21244 | GATAAAGCTGCCTGCT | 42 | 1437 |
| 1245736 | 1491 | 1506 | 21306 | 21321 | ACCGTTTTGGGCTAAT | 78 | 1438 |
| 1245762 | 1547 | 1562 | 21362 | 21377 | GACTTCAGAGTTATAC | 16 | 1439 |
| 1245788 | 1589 | 1604 | 21404 | 21419 | GACTATAAAAGGGAG | 40 | 1440 |
| 1245814 | 1702 | 1717 | 21517 | 21532 | GACCAAGGATATATGA | 48 | 1441 |
| 1245840 | 1752 | 1767 | 21567 | 21582 | TCCTGTGTTAGCTTTA | 56 | 1442 |
| 1245841 | 1765 | 1780 | 21580 | 21595 | GTACAGTTCCTTTTCC | 57 | 38 |
| 1245866 | 1798 | 1813 | 21613 | 21628 | CTCTTGGGTCCATTGT | 40 | 1443 |
| 1245892 | 2195 | 2210 | 22010 | 22025 | ATTAGTCTTGATGTAG | 67 | 1444 |
| 1245918 | 2379 | 2394 | 22194 | 22209 | AGTTTAGAAGTCAAAC | 23 | 1445 |
| 1245944 | N/A | N/A | 3530 | 3545 | TCTTAATTACATTCCC | 64 | 1446 |
| 1245970 | N/A | N/A | 3751 | 3766 | CTAAAGGTTTCTGTTG | 34 | 1447 |
| 1245996 | N/A | N/A | 4406 | 4421 | CATTCGAATTTCTTCA | 77 | 1448 |
| 1246022 | N/A | N/A | 5045 | 5060 | AGTGAATCATTCAGTA | 86 | 1449 |
| 1246048 | N/A | N/A | 5178 | 5193 | ACAGTTTAGATTGCAT | 84 | 1450 |
| 1246065 | N/A | N/A | 5659 | 5674 | ATAAGTTACCAGAGCA | 82 | 48 |
| 1246074 | N/A | N/A | 5741 | 5756 | TGATTTAGTTGGTAGC | 79 | 1451 |
| 1246100 | N/A | N/A | 5923 | 5938 | GGCAAACCTTGAATGA | 61 | 1452 |
| 1246126 | N/A | N/A | 6207 | 6222 | AACCATAGGACATGGA | 71 | 1453 |
| 1246152 | N/A | N/A | 6446 | 6461 | GTAATTCTAAACTAGT | 39 | 1454 |
| 1246178 | N/A | N/A | 6914 | 6929 | CTCGGGAAGTTTAGAC | 47 | 1455 |
| 1246204 | N/A | N/A | 7829 | 7844 | GTGGATTACATACAAG | 57 | 1456 |
| 1246230 | N/A | N/A | 8141 | 8156 | ATGTAAAGTTTGTTAG | 12 | 1457 |
| 1246256 | N/A | N/A | 8610 | 8625 | CAAGGGAACACTGTCA | 58 | 1458 |
| 1246282 | N/A | N/A | 8962 | 8977 | TCCGTTATAAGTTTCA | 65 | 1459 |

TABLE 19-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246308 | N/A | N/A | 9260 | 9275 | ACAAAATCATGGTGTG | 26 | 1460 |
| 1246334 | N/A | N/A | 9510 | 9525 | ATATTGAGGCACTGGA | 53 | 1461 |
| 1246360 | N/A | N/A | 9653 | 9668 | TAGCTAATGTATGAGG | 48 | 1462 |
| 1246386 | N/A | N/A | 9939 | 9954 | ACTAATGAATCATGAT | 39 | 1463 |
| 1246412 | N/A | N/A | 10181 | 10196 | ACTAATCTCAGTACTC | 45 | 1464 |
| 1246438 | N/A | N/A | 10498 | 10513 | CTTACCAATATGGGAT | 11 | 1465 |
| 1246464 | N/A | N/A | 11155 | 11170 | TGGAAACATGCTTGGC | 62 | 1466 |
| 1246490 | N/A | N/A | 11549 11574 | 11564 11589 | TTCTCTTGACAATGGT | 67 | 1467 |
| 1246516 | N/A | N/A | 11892 | 11907 | GTATAAATGGCAATTC | 56 | 1468 |
| 1246542 | N/A | N/A | 12251 | 12266 | TATTAGTTGGCCTGCC | 14 | 1469 |
| 1246568 | N/A | N/A | 12598 | 12613 | TCTTATCCACACCTTC | 31 | 1470 |
| 1246594 | N/A | N/A | 12704 | 12719 | AAAAAATTGGTTTCGA | 20 | 1471 |
| 1246620 | N/A | N/A | 13574 | 13589 | CTATCAGAACAGTTCA | 48 | 1472 |
| 1246646 | N/A | N/A | 13814 | 13829 | TTTTTATTGGGCCCAA | 51 | 1473 |
| 1246672 | N/A | N/A | 14008 | 14023 | AATCTAGCAACCTCTA | 22 | 1474 |
| 1246698 | N/A | N/A | 14132 | 14147 | TTTCTAAATTACTCCG | 54 | 1475 |
| 1246724 | N/A | N/A | 14382 | 14397 | TAGTGTAGAATTGTCT | 46 | 1476 |
| 1246750 | N/A | N/A | 14600 | 14615 | AGAAATCTAAGAACCC | 25 | 1477 |
| 1246776 | N/A | N/A | 15252 | 15267 | ATTCTATAGCTAAGTA | 23 | 1478 |
| 1246802 | N/A | N/A | 15366 | 15381 | GCATTAGATGGTAAGG | 64 | 1479 |
| 1246828 | N/A | N/A | 15633 | 15648 | CCATAATCTGTGATTA | 9 | 1480 |
| 1246854 | N/A | N/A | 16289 | 16304 | GTTAGAATAGTCTTCA | 46 | 1481 |
| 1246880 | N/A | N/A | 17136 | 17151 | GAATAGCCATGTAGCT | 21 | 1482 |
| 1246906 | N/A | N/A | 17996 | 18011 | ATGAAGTTAGTATAGT | 55 | 1483 |
| 1246932 | N/A | N/A | 18734 | 18749 | GCCTAGTTACAAACCA | 56 | 1484 |
| 1246958 | N/A | N/A | 18968 | 18983 | GACTAATGCAAGATTT | 55 | 1485 |
| 1246984 | N/A | N/A | 19599 | 19614 | ACTCTATAATAAGGTA | 42 | 1486 |
| 1247010 | N/A | N/A | 19785 | 19800 | ACTGATACATACCACT | 52 | 1487 |
| 1247036 | N/A | N/A | 20112 | 20127 | ATCAAGACATTCTAGC | 61 | 1488 |
| 1247062 | N/A | N/A | 20385 | 20400 | TAGTAATCACAAGTAA | 30 | 1489 |
| 1247088 | N/A | N/A | 20601 | 20616 | TAGAATACGCTGAGAG | 47 | 1490 |

TABLE 20

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245087 | 23 | 38 | 3117 | 3132 | TTCAGTCCTTGTGTAG | 45 | 1491 |
| 1245113 | 104 | 119 | 3198 | 3213 | GTAGGAGTAGATGATG | 7 | 1492 |
| 1245139 | 167 | 182 | 3261 | 3276 | AACAATCTCCCCAGCC | 59 | 1493 |
| 1245165 | 244 | 259 | 3338 | 3353 | AGAACCAATATGCTCT | 38 | 1494 |
| 1245191 | 292 | 307 | 7581 | 7596 | CGGCACTCAGCTGCAG | 55 | 1495 |
| 1245217 | 329 | 344 | 7618 | 7633 | GTCTACCACATACGCA | 66 | 1496 |
| 1245243 | 394 | 409 | 8788 | 8803 | GTTACATCACCCACTT | 41 | 1497 |
| 1245269 | 425 | 440 | 8819 | 8834 | ATATACTGTCCCAGCA | 43 | 1498 |
| 1245295 | 457 | 472 | 8851 | 8866 | TCTTCATCCTTGGTGC | 48 | 1499 |
| 1245321 | 495 | 510 | 8889 | 8904 | AATGTCCTAGGATGTT | 70 | 1500 |
| 1245347 | 552 | 567 | 10438 | 10453 | CGATGTGGCCATGATT | 44 | 1501 |
| 1245373 | 607 | 622 | 10493 | 10508 | CAATATGGGATGAGGT | 62 | 1502 |
| 1245399 | 657 | 672 | 12075 | 12090 | GTTCTGATGTCAGACC | 55 | 1503 |
| 1245425 | 731 | 746 | 12149 | 12164 | TTTGGTGAACCCAGTA | 34 | 1504 |
| 1245451 | 783 | 798 | 15664 | 15679 | TTCTTACGACTTCATC | 47 | 1505 |
| 1245477 | 835 | 850 | 15716 | 15731 | TACGATGGAACAAAAA | 20 | 1506 |
| 1245503* | 900 | 915 | 20715 | 20730 | TACGATTTAAAATCGC | 0 | 1507 |
| 1245529* | 942 | 957 | 20757 | 20772 | TGATTTTGTGGCCAAC | 72 | 1508 |
| 1245555 | 1007 | 1022 | 20822 | 20837 | TCGAAACTATTCATAT | 64 | 1509 |
| 1245581 | 1081 | 1096 | 20896 | 20911 | CTGCTAGTGCCAAACC | 74 | 1510 |
| 1245607 | 1202 | 1217 | 21017 | 21032 | GTATGTTTATGTAAGC | 80 | 1511 |
| 1245633 | 1305 | 1320 | 21120 | 21135 | ACCTTCCCTGTGTAAA | 60 | 1512 |
| 1245659 | 1334 | 1349 | 21149 | 21164 | AGATTGGAATGCTACT | 63 | 1513 |
| 1245685 | 1366 | 1381 | 21181 | 21196 | GTGTTCTTGTTGATAT | 81 | 1514 |
| 1245711 | 1415 | 1430 | 21230 | 21245 | AGATAAAGCTGCCTGC | 48 | 1515 |
| 1245737 | 1492 | 1507 | 21307 | 21322 | CACCGTTTTGGGCTAA | 85 | 1516 |
| 1245763 | 1548 | 1563 | 21363 | 21378 | GGACTTCAGAGTTATA | 36 | 1517 |
| 1245789 | 1599 | 1614 | 21414 | 21429 | TATCTTATAAGACTAT | 43 | 1518 |
| 1245815 | 1703 | 1718 | 21518 | 21533 | GGACCAAGGATATATG | 56 | 1519 |
| 1245841 | 1765 | 1780 | 21580 | 21595 | GTACAGTTCCTTTTCC | 67 | 38 |
| 1245867 | 1799 | 1814 | 21614 | 21629 | TCTCTTGGGTCCATTG | 63 | 1520 |
| 1245893 | 2196 | 2211 | 22011 | 22026 | GATTAGTCTTGATGTA | 65 | 1521 |
| 1245919 | N/A | N/A | 3356 | 3371 | ACCTTATTAATATCCC | 71 | 1522 |
| 1245945 | N/A | N/A | 3532 | 3547 | GTTCTTAATTACATTC | 64 | 1523 |
| 1245971 | N/A | N/A | 3753 | 3768 | CACTAAAGGTTTCTGT | 56 | 1524 |
| 1245997 | N/A | N/A | 4407 | 4422 | TCATTCGAATTTCTTC | 76 | 1525 |

TABLE 20-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246023 | N/A | N/A | 5046 | 5061 | GAGTGAATCATTCAGT | 87 | 1526 |
| 1246049 | N/A | N/A | 5179 | 5194 | AACAGTTTAGATTGCA | 71 | 1527 |
| 1246075 | N/A | N/A | 5742 | 5757 | CTGATTTAGTTGGTAG | 78 | 1528 |
| 1246101 | N/A | N/A | 5928 | 5943 | TTTAGGGCAAACCTTG | 67 | 1529 |
| 1246127 | N/A | N/A | 6208 | 6223 | TAACCATAGGACATGG | 70 | 1530 |
| 1246153 | N/A | N/A | 6447 | 6462 | AGTAATTCTAAACTAG | 31 | 1531 |
| 1246179 | N/A | N/A | 7101 | 7116 | AAATTGGCCTCCTGGG | 44 | 1532 |
| 1246205 | N/A | N/A | 7846 | 7861 | ATAATGGGCAGAGCTG | 53 | 1533 |
| 1246231 | N/A | N/A | 8165 | 8180 | TTATTGTAGGGATTGA | 63 | 1534 |
| 1246257 | N/A | N/A | 8612 | 8627 | GCCAAGGGAACACTGT | 61 | 1535 |
| 1246283 | N/A | N/A | 8975 | 8990 | GAAGTATGTGAACTCC | 56 | 1536 |
| 1246309 | N/A | N/A | 9312 | 9327 | ATTACTTCTGATGTCC | 65 | 1537 |
| 1246335 | N/A | N/A | 9511 | 9526 | AATATTGAGGCACTGG | 54 | 1538 |
| 1246361 | N/A | N/A | 9656 | 9671 | AGGTAGCTAATGTATG | 53 | 1539 |
| 1246387 | N/A | N/A | 9940 | 9955 | CACTAATGAATCATGA | 25 | 1540 |
| 1246413 | N/A | N/A | 10182 | 10197 | CACTAATCTCAGTACT | 48 | 1541 |
| 1246439 | N/A | N/A | 10501 | 10516 | ATACTTACCAATATGG | 0 | 1542 |
| 1246465 | N/A | N/A | 11156 | 11171 | ATGGAAACATGCTTGG | 48 | 1543 |
| 1246491 | N/A | N/A | 11565 | 11580 | CAATGGTTGATAGTTT | 47 | 1544 |
| 1246517 | N/A | N/A | 11894 | 11909 | GAGTATAAATGGCAAT | 53 | 1545 |
| 1246543 | N/A | N/A | 12252 | 12267 | CTATTAGTTGGCCTGC | 32 | 1546 |
| 1246569 | N/A | N/A | 12600 | 12615 | GTTCTTATCCACACCT | 57 | 1547 |
| 1246595 | N/A | N/A | 12705 | 12720 | TAAAAAATTGGTTTCG | 22 | 1548 |
| 1246621 | N/A | N/A | 13575 | 13590 | ACTATCAGAACAGTTC | 62 | 1549 |
| 1246647 | N/A | N/A | 13815 | 13830 | GTTTTTATTGGGCCCA | 67 | 1550 |
| 1246673 | N/A | N/A | 14009 | 14024 | CAATCTAGCAACCTCT | 51 | 1551 |
| 1246699 | N/A | N/A | 14166 | 14181 | AGCAAGCCAACAGAGA | 40 | 1552 |
| 1246725 | N/A | N/A | 14384 | 14399 | CTTAGTGTAGAATTGT | 56 | 1553 |
| 1246751 | N/A | N/A | 14614 | 14629 | AATTATTTCTTGCGAG | 16 | 1554 |
| 1246777 | N/A | N/A | 15253 | 15268 | AATTCTATAGCTAAGT | 9 | 1555 |
| 1246803 | N/A | N/A | 15367 | 15382 | GGCATTAGATGGTAAG | 62 | 1556 |
| 1246829 | N/A | N/A | 15634 | 15649 | GCCATAATCTGTGATT | 0 | 1557 |
| 1246855 | N/A | N/A | 16290 | 16305 | AGTTAGAATAGTCTTC | 67 | 1558 |
| 1246881 | N/A | N/A | 17139 | 17154 | ATTGAATAGCCATGTA | 39 | 1559 |
| 1246907 | N/A | N/A | 17997 | 18012 | TATGAAGTTAGTATAG | 30 | 1560 |
| 1246933 | N/A | N/A | 18746 | 18761 | TATATACCTGTTGCCT | 55 | 1561 |

TABLE 20-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246959 | N/A | N/A | 19388 | 19403 | ATGAGTAGGCAACTGA | 61 | 1562 |
| 1246985 | N/A | N/A | 19608 | 19623 | CTATTATGCACTCTAT | 32 | 1563 |
| 1247011 | N/A | N/A | 19786 | 19801 | CACTGATACATACCAC | 64 | 1564 |
| 1247037 | N/A | N/A | 20114 | 20129 | GCATCAAGACATTCTA | 72 | 1565 |
| 1247063 | N/A | N/A | 20387 | 20402 | TATAGTAATCACAAGT | 53 | 1566 |
| 1247089 | N/A | N/A | 20602 | 20617 | TTAGAATACGCTGAGA | 48 | 1567 |

TABLE 21

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245088 | 24 | 39 | 3118 | 3133 | GTTCAGTCCTTGTGTA | 38 | 1568 |
| 1245114 | 105 | 120 | 3199 | 3214 | AGTAGGAGTAGATGAT | 0 | 1569 |
| 1245140 | 168 | 183 | 3262 | 3277 | GAACAATCTCCCCAGC | 63 | 1570 |
| 1245166 | 245 | 260 | 3339 | 3354 | CAGAACCAATATGCTC | 56 | 1571 |
| 1245192 | 293 | 308 | 7582 | 7597 | TCGGCACTCAGCTGCA | 52 | 1572 |
| 1245218 | 330 | 345 | 7619 | 7634 | AGTCTACCACATACGC | 65 | 1573 |
| 1245244 | 395 | 410 | 8789 | 8804 | TGTTACATCACCCACT | 35 | 1574 |
| 1245270 | 426 | 441 | 8820 | 8835 | GATATACTGTCCCAGC | 34 | 1575 |
| 1245296 | 458 | 473 | 8852 | 8867 | CTCTTCATCCTTGGTG | 25 | 1576 |
| 1245322 | 496 | 511 | 8890 | 8905 | AAATGTCCTAGGATGT | 36 | 1577 |
| 1245348 | 553 | 568 | 10439 | 10454 | ACGATGTGGCCATGAT | 52 | 1578 |
| 1245374 | 608 | 623 | N/A | N/A | ACAATATGGGATGAGG | 71 | 1579 |
| 1245400 | 658 | 673 | 12076 | 12091 | AGTTCTGATGTCAGAC | 40 | 1580 |
| 1245426 | 749 | 764 | N/A | N/A | TAATCTTGTGCTTGGA | 54 | 1581 |
| 1245452 | 784 | 799 | 15665 | 15680 | CTTCTTACGACTTCAT | 45 | 1582 |
| 1245478 | 836 | 851 | 15717 | 15732 | ATACGATGGAACAAAA | 27 | 1583 |
| 1245504* | 901 | 916 | 20716 | 20731 | ATACGATTTAAAATCG | 17 | 1584 |
| 1245530* | 966 | 981 | 20781 | 20796 | GGAGCTTATTTATTCA | 38 | 1585 |
| 1245556 | 1008 | 1023 | 20823 | 20838 | TTCGAAACTATTCATA | 44 | 1586 |
| 1245582 | 1082 | 1097 | 20897 | 20912 | GCTGCTAGTGCCAAAC | 67 | 1587 |
| 1245608 | 1250 | 1265 | 21065 | 21080 | GTCCACCTTTAAATGG | 33 | 1588 |
| 1245634 | 1306 | 1321 | 21121 | 21136 | AACCTTCCCTGTGTAA | 38 | 1589 |
| 1245660 | 1335 | 1350 | 21150 | 21165 | CAGATTGGAATGCTAC | 74 | 1590 |
| 1245686 | 1367 | 1382 | 21182 | 21197 | TGTGTTCTTGTTGATA | 69 | 1591 |

TABLE 21-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245712 | 1416 | 1431 | 21231 | 21246 | GAGATAAAGCTGCCTG | 67 | 1592 |
| 1245738 | 1493 | 1508 | 21308 | 21323 | GCACCGTTTTGGGCTA | 74 | 1593 |
| 1245764 | 1551 | 1566 | 21366 | 21381 | GGTGGACTTCAGAGTT | 26 | 1594 |
| 1245790 | 1600 | 1615 | 21415 | 21430 | GTATCTTATAAGACTA | 81 | 1595 |
| 1245816 | 1704 | 1719 | 21519 | 21534 | GGGACCAAGGATATAT | 17 | 1596 |
| 1245841 | 1765 | 1780 | 21580 | 21595 | GTACAGTTCCTTTTCC | 54 | 38 |
| 1245842 | 1766 | 1781 | 21581 | 21596 | AGTACAGTTCCTTTTC | 69 | 1597 |
| 1245868 | 1800 | 1815 | 21615 | 21630 | TTCTCTTGGGTCCATT | 44 | 1598 |
| 1245894 | 2197 | 2212 | 22012 | 22027 | AGATTAGTCTTGATGT | 63 | 1599 |
| 1245920 | N/A | N/A | N/A | N/A | CACCTTATTAATATCC | 34 | 1600 |
| 1245946 | N/A | N/A | 3537 | 3552 | GCTTAGTTCTTAATTA | 28 | 1601 |
| 1245972 | N/A | N/A | 3754 | 3769 | GCACTAAAGGTTTCTG | 75 | 1602 |
| 1245998 | N/A | N/A | 4408 | 4423 | TTCATTCGAATTTCTT | 71 | 1603 |
| 1246024 | N/A | N/A | 5051 | 5066 | CCTTAGAGTGAATCAT | 65 | 1604 |
| 1246050 | N/A | N/A | 5180 | 5195 | CAACAGTTTAGATTGC | 66 | 1605 |
| 1246065 | N/A | N/A | 5659 | 5674 | ATAAGTTACCAGAGCA | 91 | 48 |
| 1246076 | N/A | N/A | 5743 | 5758 | ACTGATTTAGTTGGTA | 55 | 1606 |
| 1246102 | N/A | N/A | 5929 | 5944 | ATTTAGGGCAAACCTT | 35 | 1607 |
| 1246128 | N/A | N/A | 6209 | 6224 | ATAACCATAGGACATG | 70 | 1608 |
| 1246154 | N/A | N/A | 6453 | 6468 | CTAAGTAGTAATTCTA | 35 | 1609 |
| 1246180 | N/A | N/A | 7103 | 7118 | AAAAATTGGCCTCCTG | 41 | 1610 |
| 1246206 | N/A | N/A | 7847 | 7862 | AATAATGGGCAGAGCT | 43 | 1611 |
| 1246232 | N/A | N/A | 8166 | 8181 | GTTATTGTAGGGATTG | 69 | 1612 |
| 1246258 | N/A | N/A | 8643 | 8658 | CAAGACAGACTGTTGA | 39 | 1613 |
| 1246284 | N/A | N/A | 8976 | 8991 | AGAAGTATGTGAACTC | 41 | 1614 |
| 1246310 | N/A | N/A | 9315 | 9330 | GTAATTACTTCTGATG | 41 | 1615 |
| 1246336 | N/A | N/A | 9512 | 9527 | TAATATTGAGGCACTG | 33 | 1616 |
| 1246362 | N/A | N/A | 9659 | 9674 | TATAGGTAGCTAATGT | 31 | 1617 |
| 1246388 | N/A | N/A | 9941 | 9956 | ACACTAATGAATCATG | 7 | 1618 |
| 1246414 | N/A | N/A | 10183 | 10198 | ACACTAATCTCAGTAC | 6 | 1619 |
| 1246440 | N/A | N/A | 10502 | 10517 | GATACTTACCAATATG | 22 | 1620 |
| 1246466 | N/A | N/A | 11210 | 11225 | CTGTAGGTTTTGCTTC | 27 | 1621 |
| 1246492 | N/A | N/A | 11567 | 11582 | GACAATGGTTGATAGT | 67 | 1622 |
| 1246518 | N/A | N/A | 11925 | 11940 | GCCAAAAATCAGCCAC | 11 | 1623 |
| 1246544 | N/A | N/A | 12253 | 12268 | TCTATTAGTTGGCCTG | 26 | 1624 |
| 1246570 | N/A | N/A | 12609 | 12624 | AATTTTCGGGTTCTTA | 35 | 1625 |

TABLE 21-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246596 | N/A | N/A | 12710 | 12725 | TCCAGTAAAAAATTGG | 12 | 1626 |
| 1246622 | N/A | N/A | 13577 | 13592 | CCACTATCAGAACAGT | 31 | 1627 |
| 1246648 | N/A | N/A | 13841 | 13856 | ACGAAGCCTGAATGCC | 52 | 1628 |
| 1246674 | N/A | N/A | 14010 | 14025 | ACAATCTAGCAACCTC | 44 | 1629 |
| 1246700 | N/A | N/A | 14167 | 14182 | TAGCAAGCCAACAGAG | 21 | 1630 |
| 1246726 | N/A | N/A | 14390 | 14405 | CATAGGCTTAGTGTAG | 38 | 1631 |
| 1246752 | N/A | N/A | 14615 | 14630 | GAATTATTTCTTGCGA | 61 | 1632 |
| 1246778 | N/A | N/A | 15279 | 15294 | TCAAAGCCTGTTGGAT | 35 | 1633 |
| 1246804 | N/A | N/A | 15368 | 15383 | AGGCATTAGATGGTAA | 51 | 1634 |
| 1246830 | N/A | N/A | 15750 | 15765 | TACTTACTTCTGTAGT | 12 | 1635 |
| 1246856 | N/A | N/A | 16291 | 16306 | TAGTTAGAATAGTCTT | 23 | 1636 |
| 1246882 | N/A | N/A | 17143 | 17158 | GTAAATTGAATAGCCA | 55 | 1637 |
| 1246908 | N/A | N/A | 17999 | 18014 | CTTATGAAGTTAGTAT | 43 | 1638 |
| 1246934 | N/A | N/A | 18747 | 18762 | ATATATACCTGTTGCC | 28 | 1639 |
| 1246960 | N/A | N/A | 19389 | 19404 | GATGAGTAGGCAACTG | 42 | 1640 |
| 1246986 | N/A | N/A | 19609 | 19624 | TCTATTATGCACTCTA | 55 | 1641 |
| 1247012 | N/A | N/A | 19815 | 19830 | GTTCAAATTGGATGCA | 68 | 1642 |
| 1247038 | N/A | N/A | 20124 | 20139 | TCTGATTACAGCATCA | 48 | 1643 |
| 1247064 | N/A | N/A | 20388 | 20403 | CTATAGTAATCACAAG | 35 | 1644 |
| 1247090 | N/A | N/A | 20603 | 20618 | TTTAGAATACGCTGAG | 44 | 1645 |

TABLE 22

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245089 | 25 | 40 | 3119 | 3134 | GGTTCAGTCCTTGTGT | 57 | 1646 |
| 1245115 | 106 | 121 | 3200 | 3215 | AAGTAGGAGTAGATGA | 0 | 1647 |
| 1245141 | 171 | 186 | 3265 | 3280 | TGAGAACAATCTCCCC | 69 | 1648 |
| 1245167 | 246 | 261 | 3340 | 3355 | ACAGAACCAATATGCT | 40 | 1649 |
| 1245193 | 294 | 309 | 7583 | 7598 | TTCGGCACTCAGCTGC | 41 | 1650 |
| 1245219 | 354 | 369 | 7643 | 7658 | GATAGATCTCTTCTCT | 0 | 1651 |
| 1245245 | 396 | 411 | 8790 | 8805 | TTGTTACATCACCCAC | 34 | 1652 |
| 1245271 | 427 | 442 | 8821 | 8836 | GGATATACTGTCCCAG | 9 | 1653 |
| 1245297 | 464 | 479 | 8858 | 8873 | GGTAATCTCTTCATCC | 9 | 1654 |

TABLE 22-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245323 | 497 | 512 | 8891 | 8906 | AAAATGTCCTAGGATG | 0 | 1655 |
| 1245349 | 554 | 569 | 10440 | 10455 | GACGATGTGGCCATGA | 42 | 1656 |
| 1245375 | 609 | 624 | N/A | N/A | AACAATATGGGATGAG | 39 | 1657 |
| 1245401 | 659 | 674 | 12077 | 12092 | AAGTTCTGATGTCAGA | 7 | 1658 |
| 1245427 | 750 | 765 | N/A | N/A | ATAATCTTGTGCTTGG | 36 | 1659 |
| 1245453 | 785 | 800 | 15666 | 15681 | ACTTCTTACGACTTCA | 43 | 1660 |
| 1245479 | 837 | 852 | 15718 | 15733 | TATACGATGGAACAAA | 4 | 1661 |
| 1245505* | 902 | 917 | 20717 | 20732 | CATACGATTTAAAATC | 13 | 1662 |
| 1245531* | 967 | 982 | 20782 | 20797 | TGGAGCTTATTTATTC | 39 | 1663 |
| 1245557 | 1009 | 1024 | 20824 | 20839 | ATTCGAAACTATTCAT | 24 | 1664 |
| 1245583 | 1083 | 1098 | 20898 | 20913 | TGCTGCTAGTGCCAAA | 58 | 1665 |
| 1245609 | 1251 | 1266 | 21066 | 21081 | TGTCCACCTTTAAATG | 29 | 1666 |
| 1245635 | 1307 | 1322 | 21122 | 21137 | AAACCTTCCCTGTGTA | 34 | 1667 |
| 1245661 | 1336 | 1351 | 21151 | 21166 | ACAGATTGGAATGCTA | 50 | 1668 |
| 1245687 | 1379 | 1394 | 21194 | 21209 | GTGCACTCATTCTGTG | 6 | 1669 |
| 1245713 | 1418 | 1433 | 21233 | 21248 | TTGAGATAAAGCTGCC | 49 | 1670 |
| 1245739 | 1494 | 1509 | 21309 | 21324 | TGCACCGTTTTGGGCT | 36 | 1671 |
| 1245765 | 1552 | 1567 | 21367 | 21382 | TGGTGGACTTCAGAGT | 17 | 1672 |
| 1245791 | 1601 | 1616 | 21416 | 21431 | TGTATCTTATAAGACT | 45 | 1673 |
| 1245817 | 1705 | 1720 | 21520 | 21535 | TGGGACCAAGGATATA | 20 | 1674 |
| 1245841 | 1765 | 1780 | 21580 | 21595 | GTACAGTTCCTTTTCC | 48 | 38 |
| 1245843 | 1767 | 1782 | 21582 | 21597 | CAGTACAGTTCCTTTT | 43 | 1675 |
| 1245869 | 1801 | 1816 | 21616 | 21631 | CTTCTCTTGGGTCCAT | 51 | 1676 |
| 1245895 | 2198 | 2213 | 22013 | 22028 | AAGATTAGTCTTGATG | 25 | 1677 |
| 1245921 | N/A | N/A | N/A | N/A | TCACCTTATTAATATC | 0 | 1678 |
| 1245947 | N/A | N/A | 3546 | 3561 | AAAATCGCTGCTTAGT | 35 | 1679 |
| 1245973 | N/A | N/A | 3755 | 3770 | GGCACTAAAGGTTTCT | 62 | 1680 |
| 1245999 | N/A | N/A | 4409 | 4424 | GTTCATTCGAATTTCT | 76 | 1681 |
| 1246025 | N/A | N/A | 5053 | 5068 | AGCCTTAGAGTGAATC | 74 | 1682 |
| 1246051 | N/A | N/A | 5187 | 5202 | CCCAACGCAACAGTTT | 66 | 1683 |
| 1246065 | N/A | N/A | 5659 | 5674 | ATAAGTTACCAGAGCA | 84 | 48 |
| 1246077 | N/A | N/A | 5759 | 5774 | AATAGGAGAGTCTTTC | 47 | 1684 |
| 1246103 | N/A | N/A | 5930 | 5945 | TATTTAGGGCAAACCT | 40 | 1685 |
| 1246129 | N/A | N/A | 6210 | 6225 | CATAACCATAGGACAT | 41 | 1686 |
| 1246155 | N/A | N/A | 6454 | 6469 | GCTAAGTAGTAATTCT | 57 | 1687 |
| 1246181 | N/A | N/A | 7119 | 7134 | GATTAGTTAACCTTTT | 58 | 1688 |

TABLE 22-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246207 | N/A | N/A | 7848 | 7863 | TAATAATGGGCAGAGC | 30 | 1689 |
| 1246233 | N/A | N/A | 8171 | 8186 | ACAGAGTTATTGTAGG | 58 | 1690 |
| 1246259 | N/A | N/A | 8670 | 8685 | ATTGTATGAGGTCTCT | 49 | 1691 |
| 1246285 | N/A | N/A | 8977 | 8992 | CAGAAGTATGTGAACT | 22 | 1692 |
| 1246311 | N/A | N/A | 9329 | 9344 | CTATATACATCCAAGT | 6 | 1693 |
| 1246337 | N/A | N/A | 9513 | 9528 | CTAATATTGAGGCACT | 51 | 1694 |
| 1246363 | N/A | N/A | 9661 | 9676 | GCTATAGGTAGCTAAT | 20 | 1695 |
| 1246389 | N/A | N/A | 9942 | 9957 | CACACTAATGAATCAT | 30 | 1696 |
| 1246415 | N/A | N/A | 10185 | 10200 | CAACACTAATCTCAGT | 4 | 1697 |
| 1246441 | N/A | N/A | 10520 | 10535 | ATAACATGGCTGGCAT | 14 | 1698 |
| 1246467 | N/A | N/A | 11235 | 11250 | CATAGACATGTGTTCA | 52 | 1699 |
| 1246493 | N/A | N/A | 11568 | 11583 | TGACAATGGTTGATAG | 16 | 1700 |
| 1246519 | N/A | N/A | 11953 | 11968 | GTATCATTTGGCTTAA | 29 | 1701 |
| 1246545 | N/A | N/A | 12254 | 12269 | TTCTATTAGTTGGCCT | 28 | 1702 |
| 1246571 | N/A | N/A | 12610 | 12625 | TAATTTTCGGGTTCTT | 40 | 1703 |
| 1246597 | N/A | N/A | 12723 | 12738 | GGATTAATTCCCTTCC | 10 | 1704 |
| 1246623 | N/A | N/A | 13594 | 13609 | GATAGAGCACATGGCC | 20 | 1705 |
| 1246649 | N/A | N/A | 13842 | 13857 | CACGAAGCCTGAATGC | 24 | 1706 |
| 1246675 | N/A | N/A | 14011 | 14026 | CACAATCTAGCAACCT | 40 | 1707 |
| 1246701 | N/A | N/A | 14170 | 14185 | GAATAGCAAGCCAACA | 64 | 1708 |
| 1246727 | N/A | N/A | 14391 | 14406 | ACATAGGCTTAGTGTA | 0 | 1709 |
| 1246753 | N/A | N/A | 14616 | 14631 | CGAATTATTTCTTGCG | 58 | 1710 |
| 1246779 | N/A | N/A | 15280 | 15295 | CTCAAAGCCTGTTGGA | 10 | 1711 |
| 1246805 | N/A | N/A | 15380 | 15395 | AAAATGGTGGCGAGGC | 0 | 1712 |
| 1246831* | N/A | N/A | 15751 | 15766 | GTACTTACTTCTGTAG | 0 | 1713 |
| 1246857 | N/A | N/A | 16292 | 16307 | TTAGTTAGAATAGTCT | 8 | 1714 |
| 1246883 | N/A | N/A | 17144 | 17159 | AGTAAATTGAATAGCC | 39 | 1715 |
| 1246909 | N/A | N/A | 18000 | 18015 | GCTTATGAAGTTAGTA | 67 | 1716 |
| 1246935 | N/A | N/A | 18798 | 18813 | CGTAAAATTGTGTCTC | 43 | 1717 |
| 1246961 | N/A | N/A | 19397 | 19412 | GCATAAGAGATGAGTA | 33 | 1718 |
| 1246987 | N/A | N/A | 19610 | 19625 | ATCTATTATGCACTCT | 24 | 1719 |
| 1247013 | N/A | N/A | 19819 | 19834 | CATAGTTCAAATTGGA | 39 | 1720 |
| 1247039 | N/A | N/A | 20138 | 20153 | GGGAAAAAGTGTGTTC | 20 | 1721 |
| 1247065 | N/A | N/A | 20395 | 20410 | GTAATTGCTATAGTAA | 33 | 1722 |
| 1247091 | N/A | N/A | 20604 | 20619 | ATTTAGAATACGCTGA | 19 | 1723 |

TABLE 23

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245090 | 26 | 41 | 3120 | 3135 | TGGTTCAGTCCTTGTG | 50 | 1724 |
| 1245116 | 107 | 122 | 3201 | 3216 | CAAGTAGGAGTAGATG | 5 | 1725 |
| 1245142 | 172 | 187 | 3266 | 3281 | ATGAGAACAATCTCCC | 65 | 1726 |
| 1245168 | 247 | 262 | 3341 | 3356 | CACAGAACCAATATGC | 54 | 1727 |
| 1245194 | 295 | 310 | 7584 | 7599 | TTTCGGCACTCAGCTG | 29 | 1728 |
| 1245220 | 355 | 370 | 7644 | 7659 | CGATAGATCTCTTCTC | 15 | 1729 |
| 1245246 | 398 | 413 | 8792 | 8807 | GATTGTTACATCACCC | 65 | 1730 |
| 1245272 | 428 | 443 | 8822 | 8837 | TGGATATACTGTCCCA | 24 | 1731 |
| 1245298 | 465 | 480 | 8859 | 8874 | TGGTAATCTCTTCATC | 23 | 1732 |
| 1245324 | 500 | 515 | 8894 | 8909 | CCAAAAATGTCCTAGG | 38 | 1733 |
| 1245350 | 557 | 572 | 10443 | 10458 | TGTGACGATGTGGCCA | 42 | 1734 |
| 1245376 | 610 | 625 | N/A | N/A | GAACAATATGGGATGA | 26 | 1735 |
| 1245402 | 660 | 675 | 12078 | 12093 | GAAGTTCTGATGTCAG | 0 | 1736 |
| 1245428 | 751 | 766 | N/A | N/A | CATAATCTTGTGCTTG | 37 | 1737 |
| 1245454 | 786 | 801 | 15667 | 15682 | GACTTCTTACGACTTC | 38 | 1738 |
| 1245480 | 838 | 853 | 15719 | 15734 | ATATACGATGGAACAA | 0 | 1739 |
| 1245506* | 903 | 918 | 20718 | 20733 | GCATACGATTTAAAAT | 0 | 1740 |
| 1245532* | 969 | 984 | 20784 | 20799 | GCTGGAGCTTATTTAT | 16 | 1741 |
| 1245558 | 1010 | 1025 | 20825 | 20840 | GATTCGAAACTATTCA | 57 | 1742 |
| 1245584 | 1084 | 1099 | 20899 | 20914 | CTGCTGCTAGTGCCAA | 57 | 1743 |
| 1245610 | 1256 | 1271 | 21071 | 21086 | GCTTTTGTCCACCTTT | 68 | 1744 |
| 1245636 | 1308 | 1323 | 21123 | 21138 | TAAACCTTCCCTGTGT | 17 | 1745 |
| 1245662 | 1337 | 1352 | 21152 | 21167 | TACAGATTGGAATGCT | 46 | 1746 |
| 1245688 | 1380 | 1395 | 21195 | 21210 | TGTGCACTCATTCTGT | 18 | 1747 |
| 1245714 | 1419 | 1434 | 21234 | 21249 | GTTGAGATAAAGCTGC | 54 | 1748 |
| 1245740 | 1495 | 1510 | 21310 | 21325 | TTGCACCGTTTTGGGC | 45 | 1749 |
| 1245766 | 1553 | 1568 | 21368 | 21383 | TTGGTGGACTTCAGAG | 8 | 1750 |
| 1245792 | 1602 | 1617 | 21417 | 21432 | ATGTATCTTATAAGAC | 0 | 1751 |
| 1245818 | 1706 | 1721 | 21521 | 21536 | CTGGGACCAAGGATAT | 32 | 1752 |
| 1245841 | 1765 | 1780 | 21580 | 21595 | GTACAGTTCCTTTTCC | 50 | 38 |
| 1245844 | 1768 | 1783 | 21583 | 21598 | CCAGTACAGTTCCTTT | 66 | 1753 |
| 1245870 | 1802 | 1817 | 21617 | 21632 | TCTTCTCTTGGGTCCA | 59 | 1754 |
| 1245896 | 2199 | 2214 | 22014 | 22029 | CAAGATTAGTCTTGAT | 27 | 1755 |
| 1245922 | N/A | N/A | 3357 | 3372 | TACCTTATTAATATCC | 54 | 1756 |
| 1245948 | N/A | N/A | 3547 | 3562 | AAAAATCGCTGCTTAG | 25 | 1757 |
| 1245974 | N/A | N/A | 3834 | 3849 | GACTACGGACTGGCAA | 60 | 1758 |

TABLE 23-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246000 | N/A | N/A | 4414 | 4429 | AGAAAGTTCATTCGAA | 61 | 1759 |
| 1246026 | N/A | N/A | 5057 | 5072 | TTACAGCCTTAGAGTG | 21 | 1760 |
| 1246052 | N/A | N/A | 5200 | 5215 | TTTGAACCGTATTCCC | 69 | 1761 |
| 1246065 | N/A | N/A | 5659 | 5674 | ATAAGTTACCAGAGCA | 77 | 48 |
| 1246078 | N/A | N/A | 5760 | 5775 | GAATAGGAGAGTCTTT | 58 | 1762 |
| 1246104 | N/A | N/A | 5955 | 5970 | ATTGAGATGACAGTGG | 70 | 1763 |
| 1246130 | N/A | N/A | 6211 | 6226 | CCATAACCATAGGACA | 63 | 1764 |
| 1246156 | N/A | N/A | 6455 | 6470 | TGCTAAGTAGTAATTC | 32 | 1765 |
| 1246182 | N/A | N/A | 7121 | 7136 | AAGATTAGTTAACCTT | 24 | 1766 |
| 1246208 | N/A | N/A | 7851 | 7866 | CAATAATAATGGGCAG | 43 | 1767 |
| 1246234 | N/A | N/A | 8205 | 8220 | GAGTCATAATTTGCTT | 57 | 1768 |
| 1246260 | N/A | N/A | 8672 | 8687 | CTATTGTATGAGGTCT | 42 | 1769 |
| 1246286 | N/A | N/A | 8978 | 8993 | CCAGAAGTATGTGAAC | 8 | 1770 |
| 1246312 | N/A | N/A | 9330 | 9345 | CCTATATACATCCAAG | 53 | 1771 |
| 1246338 | N/A | N/A | 9514 | 9529 | ACTAATATTGAGGCAC | 19 | 1772 |
| 1246364 | N/A | N/A | 9662 | 9677 | AGCTATAGGTAGCTAA | 0 | 1773 |
| 1246390 | N/A | N/A | 9943 | 9958 | CCACACTAATGAATCA | 43 | 1774 |
| 1246416 | N/A | N/A | 10202 | 10217 | TATGGTAAGCCCCATG | 30 | 1775 |
| 1246442 | N/A | N/A | 10522 | 10537 | ATATAACATGGCTGGC | 29 | 1776 |
| 1246468 | N/A | N/A | 11236 | 11251 | ACATAGACATGTGTTC | 35 | 1777 |
| 1246494 | N/A | N/A | 11590 | 11605 | CTCAATAACTGAGTTA | 4 | 1778 |
| 1246520 | N/A | N/A | 11962 | 11977 | GAGAAGGCGGTATCAT | 48 | 1779 |
| 1246546 | N/A | N/A | 12255 | 12270 | CTTCTATTAGTTGGCC | 11 | 1780 |
| 1246572 | N/A | N/A | 12611 | 12626 | TTAATTTTCGGGTTCT | 31 | 1781 |
| 1246598 | N/A | N/A | 12724 | 12739 | AGGATTAATTCCCTTC | 19 | 1782 |
| 1246624 | N/A | N/A | 13595 | 13610 | GGATAGAGCACATGGC | 33 | 1783 |
| 1246650 | N/A | N/A | 13845 | 13860 | GTACACGAAGCCTGAA | 42 | 1784 |
| 1246676 | N/A | N/A | 14012 | 14027 | TCACAATCTAGCAACC | 4 | 1785 |
| 1246702 | N/A | N/A | 14171 | 14186 | TGAATAGCAAGCCAAC | 4 | 1786 |
| 1246728 | N/A | N/A | 14393 | 14408 | AAACATAGGCTTAGTG | 16 | 1787 |
| 1246754 | N/A | N/A | 14724 | 14739 | AATACCCTTGGTGGAG | 16 | 1788 |
| 1246780 | N/A | N/A | 15312 | 15327 | TAATCATGGGACAGGA | 15 | 1789 |
| 1246806 | N/A | N/A | 15381 | 15396 | CAAATGGTGGCGAGG | 10 | 1790 |
| 1246832 | N/A | N/A | 15771 | 15786 | GTATTTGGGTGTTCTG | 36 | 1791 |
| 1246858 | N/A | N/A | 16293 | 16308 | TTTAGTTAGAATAGTC | 15 | 1792 |
| 1246884 | N/A | N/A | 17227 | 17242 | GTACAAATTTATGCCA | 45 | 1793 |

TABLE 23-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246910 | N/A | N/A | 18001 | 18016 | GGCTTATGAAGTTAGT | 59 | 1794 |
| 1246936 | N/A | N/A | 18812 | 18827 | TAATTGCATCTGCTCG | 46 | 1795 |
| 1246962 | N/A | N/A | 19398 | 19413 | TGCATAAGAGATGAGT | 19 | 1796 |
| 1246988 | N/A | N/A | 19611 | 19626 | TATCTATTATGCACTC | 48 | 1797 |
| 1247014 | N/A | N/A | 19820 | 19835 | TCATAGTTCAAATTGG | 47 | 1798 |
| 1247040 | N/A | N/A | 20172 | 20187 | CAATTATGAATCTGCA | 25 | 1799 |
| 1247066 | N/A | N/A | 20396 | 20411 | AGTAATTGCTATAGTA | 48 | 1800 |
| 1247092 | N/A | N/A | 20605 | 20620 | CATTTAGAATACGCTG | 25 | 1801 |

TABLE 24

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245091 | 27 | 42 | 3121 | 3136 | CTGGTTCAGTCCTTGT | 63 | 1802 |
| 1245117 | 108 | 123 | 3202 | 3217 | CCAAGTAGGAGTAGAT | 19 | 1803 |
| 1245143 | 175 | 190 | 3269 | 3284 | GTAATGAGAACAATCT | 48 | 1804 |
| 1245169 | 248 | 263 | 3342 | 3357 | CCACAGAACCAATATG | 49 | 1805 |
| 1245195 | 296 | 311 | 7585 | 7600 | TTTTCGGCACTCAGCT | 13 | 1806 |
| 1245221 | 356 | 371 | 7645 | 7660 | GCGATAGATCTCTTCT | 24 | 1807 |
| 1245247 | 399 | 414 | 8793 | 8808 | CGATTGTTACATCACC | 47 | 1808 |
| 1245273 | 429 | 444 | 8823 | 8838 | CTGGATATACTGTCCC | 20 | 1809 |
| 1245299 | 469 | 484 | 8863 | 8878 | GTCTTGGTAATCTCTT | 37 | 1810 |
| 1245325 | 511 | 526 | N/A | N/A | GCTTTTGTGATCCAAA | 43 | 1811 |
| 1245351 | 558 | 573 | 10444 | 10459 | CTGTGACGATGTGGCC | 28 | 1812 |
| 1245377 | 611 | 626 | N/A | N/A | GGAACAATATGGGATG | 36 | 1813 |
| 1245403 | 665 | 680 | 12083 | 12098 | GGCCTGAAGTTCTGAT | 0 | 1814 |
| 1245429 | 752 | 767 | N/A | N/A | CCATAATCTTGTGCTT | 32 | 1815 |
| 1245455 | 787 | 802 | 15668 | 15683 | AGACTTCTTACGACTT | 41 | 1816 |
| 1245481 | 839 | 854 | 15720 | 15735 | GATATACGATGGAACA | 46 | 1817 |
| 1245507* | 904 | 919 | 20719 | 20734 | TGCATACGATTTAAAA | 18 | 1818 |
| 1245533* | 970 | 985 | 20785 | 20800 | GGCTGGAGCTTATTTA | 57 | 1819 |
| 1245559 | 1011 | 1026 | 20826 | 20841 | TGATTCGAAACTATTC | 29 | 1820 |
| 1245585 | 1085 | 1100 | 20900 | 20915 | ACTGCTGCTAGTGCCA | 47 | 1821 |
| 1245611 | 1257 | 1272 | 21072 | 21087 | AGCTTTGTCCACCTT | 57 | 1822 |
| 1245637 | 1310 | 1325 | 21125 | 21140 | CTTAAACCTTCCCTGT | 22 | 1823 |

TABLE 24-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245663 | 1338 | 1353 | 21153 | 21168 | CTACAGATTGGAATGC | 52 | 1824 |
| 1245689 | 1381 | 1396 | 21196 | 21211 | CTGTGCACTCATTCTG | 51 | 1825 |
| 1245715 | 1420 | 1435 | 21235 | 21250 | GGTTGAGATAAAGCTG | 76 | 1826 |
| 1245741 | 1496 | 1511 | 21311 | 21326 | GTTGCACCGTTTTGGG | 56 | 1827 |
| 1245767 | 1554 | 1569 | 21369 | 21384 | TTTGGTGGACTTCAGA | 16 | 1828 |
| 1245793 | 1613 | 1628 | 21428 | 21443 | CACCTTTCATAATGTA | 59 | 1829 |
| 1245819 | 1707 | 1722 | 21522 | 21537 | TCTGGGACCAAGGATA | 30 | 1830 |
| 1245841 | 1765 | 1780 | 21580 | 21595 | GTACAGTTCCTTTTCC | 50 | 38 |
| 1245845 | 1769 | 1784 | 21584 | 21599 | GCCAGTACAGTTCCTT | 61 | 1831 |
| 1245871 | 2174 | 2189 | 21989 | 22004 | GTCGGATTATTTTTTC | 61 | 1832 |
| 1245897 | 2200 | 2215 | 22015 | 22030 | ACAAGATTAGTCTTGA | 45 | 1833 |
| 1245923 | N/A | N/A | 3368 | 3383 | GATGTATACATTACCT | 67 | 1834 |
| 1245949 | N/A | N/A | 3549 | 3564 | ATAAAAATCGCTGCTT | 11 | 1835 |
| 1245975 | N/A | N/A | 3877 | 3892 | ATCATATGCTAAGTGC | 73 | 1836 |
| 1246001 | N/A | N/A | 4415 | 4430 | CAGAAAGTTCATTCGA | 67 | 1837 |
| 1246027 | N/A | N/A | 5061 | 5076 | TACATTACAGCCTTAG | 75 | 1838 |
| 1246053 | N/A | N/A | 5204 | 5219 | GTTTTTTGAACCGTAT | 71 | 1839 |
| 1246065 | N/A | N/A | 5659 | 5674 | ATAAGTTACCAGAGCA | 74 | 48 |
| 1246079 | N/A | N/A | 5761 | 5776 | AGAATAGGAGAGTCTT | 64 | 1840 |
| 1246105 | N/A | N/A | 5957 | 5972 | GTATTGAGATGACAGT | 68 | 1841 |
| 1246131 | N/A | N/A | 6212 | 6227 | CCCATAACCATAGGAC | 47 | 1842 |
| 1246157 | N/A | N/A | 6464 | 6479 | GCAGTAAAGTGCTAAG | 83 | 1843 |
| 1246183 | N/A | N/A | 7122 | 7137 | GAAGATTAGTTAACCT | 13 | 1844 |
| 1246209 | N/A | N/A | 7938 | 7953 | CATATTCCCTGATGAT | 14 | 1845 |
| 1246235 | N/A | N/A | 8238 | 8253 | AACTACATGACCTGGG | 27 | 1846 |
| 1246261 | N/A | N/A | 8674 | 8689 | TTCTATTGTATGAGGT | 0 | 1847 |
| 1246287 | N/A | N/A | 8980 | 8995 | GTCCAGAAGTATGTGA | 9 | 1848 |
| 1246313 | N/A | N/A | 9331 | 9346 | TCCTATATACATCCAA | 45 | 1849 |
| 1246339 | N/A | N/A | 9515 | 9530 | CACTAATATTGAGGCA | 31 | 1850 |
| 1246365 | N/A | N/A | 9663 | 9678 | CAGCTATAGGTAGCTA | 0 | 1851 |
| 1246391 | N/A | N/A | 9966 | 9981 | TAGTGTAAGCTGAGAG | 75 | 1852 |
| 1246417 | N/A | N/A | 10203 | 10218 | GTATGGTAAGCCCCAT | 36 | 1853 |
| 1246443 | N/A | N/A | 10523 | 10538 | TATATAACATGGCTGG | 8 | 1854 |
| 1246469 | N/A | N/A | 11238 | 11253 | TGACATAGACATGTGT | 42 | 1855 |
| 1246495 | N/A | N/A | 11621 | 11636 | CTGTAGGACTCTGCTC | 48 | 1856 |
| 1246521 | N/A | N/A | 11963 | 11978 | TGAGAAGGCGGTATCA | 20 | 1857 |

TABLE 24-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246547 | N/A | N/A | 12337 | 12352 | CCCTAATGTGTTTTCC | 25 | 1858 |
| 1246573 | N/A | N/A | 12612 | 12627 | CTTAATTTTCGGGTTC | 37 | 1859 |
| 1246599 | N/A | N/A | 12725 | 12740 | TAGGATTAATTCCCTT | 0 | 1860 |
| 1246625 | N/A | N/A | 13601 | 13616 | AATACAGGATAGAGCA | 0 | 1861 |
| 1246651 | N/A | N/A | 13859 | 13874 | TAGGAAAGCTCATGGT | 27 | 1862 |
| 1246677 | N/A | N/A | 14018 | 14033 | GGAAATTCACAATCTA | 22 | 1863 |
| 1246703 | N/A | N/A | 14172 | 14187 | TTGAATAGCAAGCCAA | 31 | 1864 |
| 1246729 | N/A | N/A | 14394 | 14409 | TAAACATAGGCTTAGT | 34 | 1865 |
| 1246755 | N/A | N/A | 14726 | 14741 | TAAATACCCTTGGTGG | 7 | 1866 |
| 1246781 | N/A | N/A | 15313 | 15328 | TTAATCATGGGACAGG | 27 | 1867 |
| 1246807 | N/A | N/A | 15382 | 15397 | TCAAAATGGTGGCGAG | 31 | 1868 |
| 1246833 | N/A | N/A | 15772 | 15787 | AGTATTTGGGTGTTCT | 17 | 1869 |
| 1246859 | N/A | N/A | 16327 | 16342 | TCACTATATTGCATTC | 35 | 1870 |
| 1246885 | N/A | N/A | 17239 | 17254 | AGGGAATGTTATGTAC | 49 | 1871 |
| 1246911 | N/A | N/A | 18012 | 18027 | AAAAGGCCCAAGGCTT | 30 | 1872 |
| 1246937 | N/A | N/A | 18813 | 18828 | GTAATTGCATCTGCTC | 51 | 1873 |
| 1246963 | N/A | N/A | 19399 | 19414 | ATGCATAAGAGATGAG | 30 | 1874 |
| 1246989 | N/A | N/A | 19649 | 19664 | CTATGCAAGCCTTCAC | 19 | 1875 |
| 1247015 | N/A | N/A | 19827 | 19842 | GTAATATTCATAGTTC | 49 | 1876 |
| 1247041 | N/A | N/A | 20173 | 20188 | CCAATTATGAATCTGC | 61 | 1877 |
| 1247067 | N/A | N/A | 20397 | 20412 | TAGTAATTGCTATAGT | 7 | 1878 |
| 1247093 | N/A | N/A | 20606 | 20621 | TCATTTAGAATACGCT | 20 | 1879 |

TABLE 25

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245092 | 31 | 46 | 3125 | 3140 | CCTTCTGGTTCAGTCC | 72 | 1880 |
| 1245118 | 109 | 124 | 3203 | 3218 | TCCAAGTAGGAGTAGA | 24 | 1881 |
| 1245144 | 176 | 191 | 3270 | 3285 | AGTAATGAGAACAATC | 45 | 1882 |
| 1245170 | 249 | 264 | 3343 | 3358 | CCCACAGAACCAATAT | 16 | 1883 |
| 1245196 | 297 | 312 | 7586 | 7601 | GTTTTCGGCACTCAGC | 51 | 1884 |
| 1245222 | 357 | 372 | 7646 | 7661 | AGCGATAGATCTCTTC | 31 | 1885 |
| 1245248 | 400 | 415 | 8794 | 8809 | ACGATTGTTACATCAC | 53 | 1886 |

TABLE 25-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245274 | 430 | 445 | 8824 | 8839 | GCTGGATATACTGTCC | 36 | 1887 |
| 1245300 | 471 | 486 | 8865 | 8880 | ATGTCTTGGTAATCTC | 23 | 1888 |
| 1245326 | 513 | 528 | N/A | N/A | GTGCTTTTGTGATCCA | 62 | 1889 |
| 1245352 | 559 | 574 | 10445 | 10460 | ACTGTGACGATGTGGC | 40 | 1890 |
| 1245378 | 612 | 627 | N/A | N/A | TGGAACAATATGGGAT | 46 | 1891 |
| 1245404 | 667 | 682 | 12085 | 12100 | AAGGCCTGAAGTTCTG | 5 | 1892 |
| 1245430 | 755 | 770 | N/A | N/A | AGGCCATAATCTTGTG | 33 | 1893 |
| 1245456 | 788 | 803 | 15669 | 15684 | CAGACTTCTTACGACT | 33 | 1894 |
| 1245482 | 840 | 855 | 15721 | 15736 | TGATATACGATGGAAC | 13 | 1895 |
| 1245508* | 905 | 920 | 20720 | 20735 | CTGCATACGATTTAAA | 32 | 1896 |
| 1245534* | 971 | 986 | 20786 | 20801 | TGGCTGGAGCTTATTT | 87 | 1897 |
| 1245560 | 1012 | 1027 | 20827 | 20842 | TTGATTCGAAACTATT | 55 | 1898 |
| 1245586 | 1086 | 1101 | 20901 | 20916 | GACTGCTGCTAGTGCC | 67 | 1899 |
| 1245612 | 1258 | 1273 | 21073 | 21088 | TAGCTTTTGTCCACCT | 60 | 1900 |
| 1245638 | 1312 | 1327 | 21127 | 21142 | GTCTTAAACCTTCCCT | 63 | 1901 |
| 1245664 | 1339 | 1354 | 21154 | 21169 | GCTACAGATTGGAATG | 47 | 1902 |
| 1245690 | 1383 | 1398 | 21198 | 21213 | AGCTGTGCACTCATTC | 57 | 1903 |
| 1245716 | 1421 | 1436 | 21236 | 21251 | AGGTTGAGATAAAGCT | 74 | 1904 |
| 1245742 | 1497 | 1512 | 21312 | 21327 | AGTTGCACCGTTTTGG | 55 | 1905 |
| 1245768 | 1556 | 1571 | 21371 | 21386 | CTTTTGGTGGACTTCA | 10 | 1906 |
| 1245794 | 1615 | 1630 | 21430 | 21445 | GTCACCTTTCATAATG | 45 | 1907 |
| 1245820 | 1708 | 1723 | 21523 | 21538 | CTCTGGGACCAAGGAT | 51 | 1908 |
| 1245841 | 1765 | 1780 | 21580 | 21595 | GTACAGTTCCTTTTCC | 55 | 38 |
| 1245846 | 1770 | 1785 | 21585 | 21600 | AGCCAGTACAGTTCCT | 58 | 1909 |
| 1245872 | 2175 | 2190 | 21990 | 22005 | AGTCGGATTATTTTTT | 42 | 1910 |
| 1245898 | 2201 | 2216 | 22016 | 22031 | AACAAGATTAGTCTTG | 40 | 1911 |
| 1245924 | N/A | N/A | 3401 | 3416 | CATATCTTACTCTGTG | 47 | 1912 |
| 1245950 | N/A | N/A | 3550 | 3565 | CATAAAAATCGCTGCT | 45 | 1913 |
| 1245976 | N/A | N/A | 3882 | 3897 | CGTTTATCATATGCTA | 88 | 1914 |
| 1246002 | N/A | N/A | 4416 | 4431 | CCAGAAAGTTCATTCG | 81 | 1915 |
| 1246028 | N/A | N/A | 5062 | 5077 | TTACATTACAGCCTTA | 67 | 1916 |
| 1246054 | N/A | N/A | 5218 | 5233 | TTAAACTCCAATGTGT | 36 | 1917 |
| 1246065 | N/A | N/A | 5659 | 5674 | ATAAGTTACCAGAGCA | 82 | 48 |
| 1246080 | N/A | N/A | 5800 | 5815 | CTCAAATAGCCTTTTG | 64 | 1918 |
| 1246106 | N/A | N/A | 5979 | 5994 | CCTGAAAGCCCTATT | 0 | 1919 |
| 1246132 | N/A | N/A | 6222 | 6237 | ACCAAACTTGCCCATA | 46 | 1920 |

TABLE 25-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246158 | N/A | N/A | 6465 | 6480 | GGCAGTAAAGTGCTAA | 62 | 1921 |
| 1246184 | N/A | N/A | 7123 | 7138 | TGAAGATTAGTTAACC | 21 | 1922 |
| 1246210 | N/A | N/A | 7941 | 7956 | ATCCATATTCCCTGAT | 26 | 1923 |
| 1246236 | N/A | N/A | 8239 | 8254 | TAACTACATGACCTGG | 37 | 1924 |
| 1246262 | N/A | N/A | 8688 | 8703 | GATGAGAGTCTTTCTT | 26 | 1925 |
| 1246288 | N/A | N/A | 9000 | 9015 | AAAGATCTGGCCAGTT | 3 | 1926 |
| 1246314 | N/A | N/A | 9332 | 9347 | ATCCTATATACATCCA | 76 | 1927 |
| 1246340 | N/A | N/A | 9516 | 9531 | ACACTAATATTGAGGC | 68 | 1928 |
| 1246366 | N/A | N/A | 9712 | 9727 | GAACATACATTGTTGC | 58 | 1929 |
| 1246392 | N/A | N/A | 9972 | 9987 | GTTGAGTAGTGTAAGC | 53 | 1930 |
| 1246418 | N/A | N/A | 10209 | 10224 | TTATTGGTATGGTAAG | 14 | 1931 |
| 1246444 | N/A | N/A | 10728 | 10743 | GTAATTGGCTCTTGAG | 44 | 1932 |
| 1246470 | N/A | N/A | 11239 | 11254 | ATGACATAGACATGTG | 23 | 1933 |
| 1246496 | N/A | N/A | 11652 | 11667 | CTACAAAACTGGTATC | 0 | 1934 |
| 1246522 | N/A | N/A | 11982 | 11997 | ACCAATCCTCAGCTTT | 11 | 1935 |
| 1246548 | N/A | N/A | 12353 | 12368 | GATCATTCCTGCTAGT | 35 | 1936 |
| 1246574 | N/A | N/A | 12613 | 12628 | GCTTAATTTTCGGGTT | 36 | 1937 |
| 1246600 | N/A | N/A | 12726 | 12741 | TTAGGATTAATTCCCT | 14 | 1938 |
| 1246626 | N/A | N/A | 13603 | 13618 | ACAATACAGGATAGAG | 23 | 1939 |
| 1246652 | N/A | N/A | 13860 | 13875 | TTAGGAAAGCTCATGG | 26 | 1940 |
| 1246678 | N/A | N/A | 14026 | 14041 | CTTACTAAGGAAATTC | 19 | 1941 |
| 1246704 | N/A | N/A | 14174 | 14189 | CCTTGAATAGCAAGCC | 61 | 1942 |
| 1246730 | N/A | N/A | 14395 | 14410 | ATAAACATAGGCTTAG | 41 | 1943 |
| 1246756 | N/A | N/A | 14728 | 14743 | TCTAAATACCCTTGGT | 26 | 1944 |
| 1246782 | N/A | N/A | 15314 | 15329 | ATTAATCATGGGACAG | 20 | 1945 |
| 1246808 | N/A | N/A | 15383 | 15398 | ATCAAAATGGTGGCGA | 20 | 1946 |
| 1246834 | N/A | N/A | 15773 | 15788 | TAGTATTTGGGTGTTC | 27 | 1947 |
| 1246860 | N/A | N/A | 16377 | 16392 | ACCAAACTTCCAGCAG | 31 | 1948 |
| 1246886 | N/A | N/A | 17675 | 17690 | CAAACCTTTGTTGCC | 14 | 1949 |
| 1246912 | N/A | N/A | 18015 | 18030 | TCAAAAGGCCCAAGG | 46 | 1950 |
| 1246938 | N/A | N/A | 18814 | 18829 | AGTAATTGCATCTGCT | 42 | 1951 |
| 1246964 | N/A | N/A | 19404 | 19419 | CAGGAATGCATAAGAG | 33 | 1952 |
| 1246990 | N/A | N/A | 19662 | 19677 | ACCAGAATCCATTCTA | 60 | 1953 |
| 1247016 | N/A | N/A | 19860 | 19875 | AATCAATCTGTCTGAA | 34 | 1954 |
| 1247042 | N/A | N/A | 20174 | 20189 | CCCAATTATGAATCTG | 62 | 1955 |

TABLE 25-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1247068 | N/A | N/A | 20398 | 20413 | ATAGTAATTGCTATAG | 36 | 1956 |
| 1247094 | N/A | N/A | 20607 | 20622 | GTCATTTAGAATACGC | 46 | 1957 |

TABLE 26

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245093 | 58 | 73 | 3152 | 3167 | ATGTTCATGGCTTTGC | 73 | 1958 |
| 1245119 | 110 | 125 | 3204 | 3219 | CTCCAAGTAGGAGTAG | 5 | 1959 |
| 1245145 | 180 | 195 | 3274 | 3289 | CTCCAGTAATGAGAAC | 40 | 1960 |
| 1245171 | 250 | 265 | 3344 | 3359 | TCCCACAGAACCAATA | 24 | 1961 |
| 1245197 | 298 | 313 | 7587 | 7602 | AGTTTTCGGCACTCAG | 16 | 1962 |
| 1245223 | 358 | 373 | 7647 | 7662 | GAGCGATAGATCTCTT | 0 | 1963 |
| 1245249 | 401 | 416 | 8795 | 8810 | CACGATTGTTACATCA | 37 | 1964 |
| 1245275 | 431 | 446 | 8825 | 8840 | GGCTGGATATACTGTC | 18 | 1965 |
| 1245301 | 472 | 487 | 8866 | 8881 | AATGTCTTGGTAATCT | 20 | 1966 |
| 1245327 | 514 | 529 | N/A | N/A | AGTGCTTTTGTGATCC | 25 | 1967 |
| 1245353 | 560 | 575 | 10446 | 10461 | CACTGTGACGATGTGG | 10 | 1968 |
| 1245379 | 613 | 628 | N/A | N/A | CTGGAACAATATGGGA | 38 | 1969 |
| 1245405 | 669 | 684 | 12087 | 12102 | CCAAGGCCTGAAGTTC | 20 | 1970 |
| 1245431 | 758 | 773 | N/A | N/A | TACAGGCCATAATCTT | 16 | 1971 |
| 1245457 | 789 | 804 | 15670 | 15685 | TCAGACTTCTTACGAC | 36 | 1972 |
| 1245483 | 841 | 856 | 15722 | 15737 | TTGATATACGATGGAA | 38 | 1973 |
| 1245509* | 906 | 921 | 20721 | 20736 | TCTGCATACGATTTAA | 44 | 1974 |
| 1245535* | 972 | 987 | 20787 | 20802 | CTGGCTGGAGCTTATT | 82 | 1975 |
| 1245561 | 1013 | 1028 | 20828 | 20843 | ATTGATTCGAAACTAT | 22 | 1976 |
| 1245587 | 1087 | 1102 | 20902 | 20917 | TGACTGCTGCTAGTGC | 50 | 1977 |
| 1245613 | 1259 | 1274 | 21074 | 21089 | GTAGCTTTTGTCCACC | 63 | 1978 |
| 1245639 | 1313 | 1328 | 21128 | 21143 | AGTCTTAAACCTTCCC | 77 | 1979 |
| 1245665 | 1340 | 1355 | 21155 | 21170 | GGCTACAGATTGGAAT | 23 | 1980 |
| 1245691 | 1384 | 1399 | 21199 | 21214 | TAGCTGTGCACTCATT | 40 | 1981 |
| 1245717 | 1422 | 1437 | 21237 | 21252 | CAGGTTGAGATAAAGC | 49 | 1982 |
| 1245743 | 1498 | 1513 | 21313 | 21328 | GAGTTGCACCGTTTTG | 48 | 1983 |
| 1245769 | 1557 | 1572 | 21372 | 21387 | ACTTTTGGTGGACTTC | 0 | 1984 |
| 1245795 | 1616 | 1631 | 21431 | 21446 | GGTCACCTTTCATAAT | 57 | 1985 |

TABLE 26-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1245821 | 1709 | 1724 | 21524 | 21539 | TCTCTGGGACCAAGGA | 56 | 1986 |
| 1245841 | 1765 | 1780 | 21580 | 21595 | GTACAGTTCCTTTTCC | 44 | 38 |
| 1245847 | 1771 | 1786 | 21586 | 21601 | TAGCCAGTACAGTTCC | 52 | 1987 |
| 1245873 | 2176 | 2191 | 21991 | 22006 | GAGTCGGATTATTTTT | 44 | 1988 |
| 1245899 | 2204 | 2219 | 22019 | 22034 | CAAAACAAGATTAGTC | 18 | 1989 |
| 1245925 | N/A | N/A | 3403 | 3418 | TACATATCTTACTCTG | 40 | 1990 |
| 1245951 | N/A | N/A | 3551 | 3566 | TCATAAAAATCGCTGC | 26 | 1991 |
| 1245977 | N/A | N/A | 3902 | 3917 | GTTTATCATGTGCCAC | 83 | 1992 |
| 1246003 | N/A | N/A | 4434 | 4449 | GTAAATTCTTGCTATC | 40 | 1993 |
| 1246029 | N/A | N/A | 5063 | 5078 | GTTACATTACAGCCTT | 71 | 1994 |
| 1246055 | N/A | N/A | 5221 | 5236 | AGCTTAAACTCCAATG | 40 | 1995 |
| 1246065 | N/A | N/A | 5659 | 5674 | ATAAGTTACCAGAGCA | 80 | 48 |
| 1246081 | N/A | N/A | 5816 | 5831 | TCAAAGTCAGTATCCC | 79 | 1996 |
| 1246107 | N/A | N/A | 5983 | 5998 | GATACCTGAAAAGCCC | 49 | 1997 |
| 1246133 | N/A | N/A | 6223 | 6238 | TACCAAACTTGCCCAT | 33 | 1998 |
| 1246159 | N/A | N/A | 6473 | 6488 | ATGTAATAGGCAGTAA | 33 | 1999 |
| 1246185 | N/A | N/A | 7481 | 7496 | ACAATTAACATTCGGC | 77 | 2000 |
| 1246211 | N/A | N/A | 7950 | 7965 | TAGGAAGTGATCCATA | 30 | 2001 |
| 1246237 | N/A | N/A | 8240 | 8255 | ATAACTACATGACCTG | 29 | 2002 |
| 1246263 | N/A | N/A | 8693 | 8708 | CCAAAGATGAGAGTCT | 19 | 2003 |
| 1246289 | N/A | N/A | 9001 | 9016 | CAAAGATCTGGCCAGT | 1 | 2004 |
| 1246315 | N/A | N/A | 9346 | 9361 | CAAAAGTGTCCTCGAT | 5 | 2005 |
| 1246341 | N/A | N/A | 9517 | 9532 | TACACTAATATTGAGG | 30 | 2006 |
| 1246367 | N/A | N/A | 9713 | 9728 | TGAACATACATTGTTG | 29 | 2007 |
| 1246393 | N/A | N/A | 9976 | 9991 | GACAGTTGAGTAGTGT | 46 | 2008 |
| 1246419 | N/A | N/A | 10210 | 10225 | TTTATTGGTATGGTAA | 25 | 2009 |
| 1246445 | N/A | N/A | 10729 | 10744 | TGTAATTGGCTCTTGA | 0 | 2010 |
| 1246471 | N/A | N/A | 11248 | 11263 | ACCAAGGCCATGACAT | 17 | 2011 |
| 1246497 | N/A | N/A | 11653 | 11668 | TCTACAAAACTGGTAT | 9 | 2012 |
| 1246523 | N/A | N/A | 11983 | 11998 | AACCAATCCTCAGCTT | 0 | 2013 |
| 1246549 | N/A | N/A | 12411 | 12426 | GATCAAATGTATGTGC | 25 | 2014 |
| 1246575 | N/A | N/A | 12614 | 12629 | GGCTTAATTTTCGGGT | 17 | 2015 |
| 1246601 | N/A | N/A | 12727 | 12742 | TTTAGGATTAATTCCC | 16 | 2016 |
| 1246627 | N/A | N/A | 13604 | 13619 | GACAATACAGGATAGA | 43 | 2017 |
| 1246653 | N/A | N/A | 13861 | 13876 | CTTAGGAAAGCTCATG | 0 | 2018 |
| 1246679 | N/A | N/A | 14027 | 14042 | CCTTACTAAGGAAATT | 28 | 2019 |

TABLE 26-continued

Inhibition of HSD17B13 RNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | HSD17B13 (% Inhibition) | SEQ ID NO |
|---|---|---|---|---|---|---|---|
| 1246705 | N/A | N/A | 14194 | 14209 | TGTGATTGAGTTCTCC | 62 | 2020 |
| 1246731 | N/A | N/A | 14397 | 14412 | TCATAAACATAGGCTT | 58 | 2021 |
| 1246757 | N/A | N/A | 14729 | 14744 | CTCTAAATACCCTTGG | 7 | 2022 |
| 1246783 | N/A | N/A | 15315 | 15330 | GATTAATCATGGGACA | 9 | 2023 |
| 1246809 | N/A | N/A | 15384 | 15399 | TATCAAAATGGTGGCG | 18 | 2024 |
| 1246835 | N/A | N/A | 15774 | 15789 | TTAGTATTTGGGTGTT | 29 | 2025 |
| 1246861 | N/A | N/A | 16382 | 16397 | TCCCAACCAAACTTCC | 82 | 2026 |
| 1246887 | N/A | N/A | 17766 | 17781 | GCATATTCATTTGGCC | 6 | 2027 |
| 1246913 | N/A | N/A | 18018 | 18033 | GTTTCAAAAGGCCCA | 39 | 2028 |
| 1246939 | N/A | N/A | 18815 | 18830 | TAGTAATTGCATCTGC | 51 | 2029 |
| 1246965 | N/A | N/A | 19436 | 19451 | TGGAGGAAAGCTTCAA | 10 | 2030 |
| 1246991 | N/A | N/A | 19675 | 19690 | ACCAAGAGACACCACC | 41 | 2031 |
| 1247017 | N/A | N/A | 19889 | 19904 | CTTACGACAGGTCATC | 39 | 2032 |
| 1247043 | N/A | N/A | 20185 | 20200 | TTAGAAGTCAGCCCAA | 37 | 2033 |
| 1247069 | N/A | N/A | 20400 | 20415 | CTATAGTAATTGCTAT | 0 | 2034 |
| 1247095 | N/A | N/A | 20608 | 20623 | GGTCATTTAGAATACG | 39 | 2035 |

Example 2: Dose-Dependent Inhibition of Human HSD17B13 in HepaRG Cells by cEt Gapmers Certain modified oligonucleotides described in the studies above exhibiting significant in vitro inhibition of HSD17B13 RNA were selected and tested at various doses in HepaRG cells.

The modified oligonucleotides were tested in a series of experiments using the same culture conditions. The results for each experiment are presented in separate tables shown below. Cultured HepaRG cells at a density of 30,000 cells per well were transfected using electroporation with modified oligonucleotides diluted to different concentrations as specified in the Tables below. After a treatment period of approximately 24 hours, HSD17B13 RNA levels were measured as previously described using the Human HSD17B13 primer-probe set RTS43553. HSD17B13 RNA levels were normalized to total RNA, as measured by RIBOGREEN®. Results are presented in the tables below as percent inhibition of HSD17B13, relative to untreated control cells.

The half maximal inhibitory concentration ($IC_{50}$) of each modified oligonucleotide was calculated using a linear regression on a log/linear plot of the data in excel and is also presented in the Tables below.

TABLE 27

Multi-dose assay of modified oligonucleotides in HepaRG cells

| ION No. | % Inhibition | | | | | IC50 ($\mu$M) |
|---|---|---|---|---|---|---|
| | 6 nM | 32 nM | 160 nM | 800 nM | 4000 nM | |
| 1245651 | 0 | 6 | 24 | 57 | 82 | 0.6 |
| 1245927 | 0 | 19 | 55 | 80 | 90 | 0.2 |
| 1245930 | 0 | 0 | 30 | 77 | 86 | 0.4 |
| 1245957 | 8 | 8 | 49 | 77 | 87 | 0.2 |
| 1245984 | 12 | 14 | 62 | 78 | 90 | 0.1 |
| 1246065 | 0 | 10 | 46 | 65 | 89 | 0.3 |
| 1246066 | 0 | 13 | 35 | 58 | 76 | 0.5 |
| 1246068 | 0 | 5 | 30 | 61 | 83 | 0.5 |
| 1246110 | 3 | 12 | 44 | 82 | 87 | 0.2 |
| 1246115 | 8 | 14 | 45 | 75 | 89 | 0.2 |
| 1246116 | 6 | 17 | 48 | 72 | 83 | 0.2 |
| 1246134 | 3 | 21 | 55 | 79 | 91 | 0.2 |
| 1246163 | 2 | 15 | 43 | 75 | 92 | 0.2 |

TABLE 28

Multi-dose assay of modified oligonucleotides in HepaRG cells

| ION No. | % Inhibition | | | | | IC50 ($\mu$M) |
|---|---|---|---|---|---|---|
| | 6 nM | 32 nM | 160 nM | 800 nM | 4000 nM | |
| 1245681 | 0 | 12 | 38 | 72 | 90 | 0.3 |
| 1245790 | 1 | 8 | 37 | 67 | 93 | 0.3 |
| 1245968 | 15 | 23 | 49 | 75 | 93 | 0.2 |
| 1245976 | 0 | 16 | 49 | 73 | 88 | 0.2 |

TABLE 28-continued

Multi-dose assay of modified oligonucleotides in HepaRG cells

| ION No. | % Inhibition | | | | | IC50 (µM) |
|---|---|---|---|---|---|---|
| | 6 nM | 32 nM | 160 nM | 800 nM | 4000 nM | |
| 1245977 | 0 | 10 | 41 | 75 | 77 | 0.3 |
| 1245999 | 1 | 14 | 48 | 82 | 90 | 0.2 |
| 1246022 | 13 | 24 | 56 | 83 | 93 | 0.1 |
| 1246023 | 13 | 24 | 66 | 90 | 93 | 0.1 |
| 1246104 | 0 | 0 | 35 | 67 | 87 | 0.4 |
| 1246157 | 0 | 22 | 40 | 75 | 84 | 0.3 |
| 1246226 | 11 | 7 | 40 | 71 | 88 | 0.3 |
| 1246667 | 89 | 95 | 97 | 98 | 100 | <0.006 |
| 1246853 | 0 | 2 | 11 | 57 | 82 | 0.7 |
| 1246861 | 4 | 0 | 12 | 31 | 67 | 2.6 |

Example 3: Antisense Inhibition of Human HSD17B13 in HepaRG Cells by cEt Gapmers Additional modified oligonucleotides complementary to an HSD17B13 nucleic acid were synthesized and tested for their effect on HSD17B13 RNA levels in vitro. The modified oligonucleotides were tested in a series of experiments using the same culture conditions. The results for each experiment are presented in separate tables shown below.

Cultured HepaRG cells at a density of 30,000 cells per well were transfected using electroporation with 1,000 nM of modified oligonucleotide. After a treatment period of approximately 24 hours, RNA was isolated from the cells and HSD17B13 RNA levels were measured by quantitative real-time RTPCR. Human primer probe set RTS43553 was used to measure RNA levels. HSD17B13 RNA levels were adjusted according to total RNA content, as measured by RIBOGREEN® S. Results are presented as percent inhibition of HSD17B13 relative to untreated control cells. As used herein, a value of '0' indicates that treatment with the modified oligonucleotide did not inhibit HSD17B13 mRNA levels. An asterisk (*) indicates that the modified oligonucleotide is complementary to the target transcript within the amplicon region of the primer probe set and so, the associated data is not reliable. In such instances, additional using alternate primer probe sets must be performed to accurately assess the potency and efficacy of such modified oligonucleotides.

The modified oligonucleotides described in the tables below were 3-10-3 cEt gapmers. The internucleoside linkages throughout each modified oligonucleotide were phosphorothioate (P=S) linkages. All cytosine residues throughout each modified oligonucleotide were 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the Tables below, the modified oligonucleotide are complementary to either the human HSD17B13 mRNA, designated herein as SEQ ID NO: 1 (GENBANK Accession No. NM_178135.4) or to the human HSD17B13 genomic sequence, designated herein as SEQ ID NO: 2 (the complement of GENBANK Accession No. NC_000004.12 truncated from nucleotides 87301001 to 87326000) or to both. 'N/A' indicates that the modified oligonucleotide is not complementary to that particular target sequence with 100% complementarity.

TABLE 29

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 91 | 121 |
| 1246023 | N/A | N/A | 5046 | 5061 | GAGTGAATCATTCAGT | 89 | 1526 |
| 1340071 | N/A | N/A | 20191 | 20206 | CAGTTATTAGAAGTCA | 85 | 2036 |
| 1340085 | N/A | N/A | 20588 | 20603 | GAGTTATCTGGTTTGC | 84 | 2037 |
| 1340086 | N/A | N/A | 9335 | 9350 | TCGATCCTATATACAT | 40 | 2038 |
| 1340096 | N/A | N/A | 19711 | 19726 | GCTGAAACTGCTGATT | 38 | 2039 |
| 1340099 | 1763 | 1778 | 21578 | 21593 | ACAGTTCCTTTTCCTG | 58 | 2040 |
| 1340104 | N/A | N/A | 10500 | 10515 | TACTTACCAATATGGG | 13 | 2041 |
| 1340120 | N/A | N/A | 11585 | 11600 | TAACTGAGTTATTCTC | 41 | 2042 |
| 1340158 | N/A | N/A | 6440 | 6455 | CTAAACTAGTGGTAAT | 23 | 2043 |
| 1340170 | N/A | N/A | 9657 | 9672 | TAGGTAGCTAATGTAT | 34 | 2044 |
| 1340194 | N/A | N/A | 11077 | 11092 | TAATTACAACCTGGTT | 52 | 2045 |
| 1340201 | N/A | N/A | 14279 | 14294 | GTAAAGGCTGGGTGAG | 41 | 2046 |
| 1340204 | N/A | N/A | 12202 | 12217 | TCATACCACATACCCA | 41 | 2047 |
| 1340209 | N/A | N/A | 18520 | 18535 | CTTAGTACCAAGACAC | 60 | 2048 |
| 1340231 | N/A | N/A | 16134 | 16149 | GATGCTCCATAATAAT | 42 | 2049 |

TABLE 29-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340239 | N/A | N/A | 19912 | 19927 | TGCATCTTAAGATACC | 81 | 2050 |
| 1340247 | N/A | N/A | 16286 | 16301 | AGAATAGTCTTCAGCA | 80 | 2051 |
| 1340256 | N/A | N/A | 19532 | 19547 | GGCTAAAATGGTCATC | 75 | 2052 |
| 1340276 | N/A | N/A | 19394 | 19409 | TAAGAGATGAGTAGGC | 46 | 2053 |
| 1340278 | N/A | N/A | 15250 | 15265 | TCTATAGCTAAGTATA | 0 | 2054 |
| 1340279 | N/A | N/A | 17802 | 17817 | TATTCTTATGTCATCC | 75 | 2055 |
| 1340290 | 809 | 824 | 15690 | 15705 | ATTGGTAAGTATTCCA | 50 | 2056 |
| 1340305 | 1177 | 1192 | 20992 | 21007 | TTTAAGAGGCATGAAA | 40 | 2057 |
| 1340308 | N/A | N/A | 20111 | 20126 | TCAAGACATTCTAGCC | 79 | 2058 |
| 1340330 | N/A | N/A | 12476 | 12491 | CTAGATACTCAATTTA | 30 | 2059 |
| 1340360 | N/A | N/A | 12800 | 12815 | GGCTGTAAGAGTCAGT | 88 | 2060 |
| 1340368 | N/A | N/A | 13827 | 13842 | CCTACCAAGAGGGTTT | 34 | 2061 |
| 1340380 | N/A | N/A | 12005 | 12020 | ATTGTTAGCTAAGGGA | 22 | 2062 |
| 1340390 | N/A | N/A | 14175 | 14190 | GCCTTGAATAGCAAGC | 32 | 2063 |
| 1340405 | N/A | N/A | 13598 | 13613 | ACAGGATAGAGCACAT | 44 | 2064 |
| 1340412 | N/A | N/A | 14914 | 14929 | ACATTAGCAAGCTAAG | 52 | 2065 |
| 1340423 | N/A | N/A | 9538 | 9553 | ATCCAGATCTGCCCTA | 39 | 2066 |
| 1340427 | N/A | N/A | 8535 | 8550 | TTGCAAGTTTATCAGT | 66 | 2067 |
| 1340432 | N/A | N/A | 4225 | 4240 | GTTTCAACTAAACATG | 65 | 2068 |
| 1340438 | N/A | N/A | 3479 | 3494 | GGACCAGGGAATTTAT | 55 | 2069 |
| 1340439 | 1255 | 1270 | 21070 | 21085 | CTTTTGTCCACCTTTA | 76 | 2070 |
| 1340448 | N/A | N/A | 5672 | 5687 | GTCAGTAGAGAGCATA | 85 | 2071 |
| 1340453 | N/A | N/A | 6084 | 6099 | TTTCACCTCAGGTGAC | 52 | 2072 |
| 1340459 | N/A | N/A | 5083 | 5098 | CTCGCCTAAAGGAGAT | 56 | 2073 |
| 1340465 | N/A | N/A | 5895 | 5910 | TCCTTTGTATTTCGCT | 68 | 2074 |
| 1340479 | N/A | N/A | 6785 | 6800 | CCTCCTTATTTGTTAG | 41 | 2075 |
| 1340491 | N/A | N/A | 3699 | 3714 | TTTCAGATCCCGTTCT | 45 | 2076 |
| 1340525 | N/A | N/A | 9965 | 9980 | AGTGTAAGCTGAGAGT | 71 | 2077 |
| 1340542 | N/A | N/A | 5186 | 5201 | CCAACGCAACAGTTTA | 77 | 2078 |
| 1340546 | N/A | N/A | 5647 | 5662 | AGCATTCATCAGATGT | 83 | 2079 |
| 1340556 | N/A | N/A | 5268 | 5283 | TTGCAAAATGTGATGC | 75 | 2080 |
| 1340563 | N/A | N/A | 3990 | 4005 | GTGTTTACAAGTAAGA | 79 | 2081 |
| 1340567 | N/A | N/A | 6260 | 6275 | AGATGGGCAAGGCCAC | 59 | 2082 |
| 1340576 | N/A | N/A | 11499 | 11514 | CTGGAGAAGAGTTTAC | 38 | 2083 |
| 1340580 | N/A | N/A | 8641 | 8656 | AGACAGACTGTTGAGC | 74 | 2084 |
| 1340597 | N/A | N/A | 18036 | 18051 | CATAGTTTATATGGAT | 56 | 2085 |

TABLE 29-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340601 | N/A | N/A | 18138 | 18153 | TGTTATCTCAAGTCAG | 81 | 2086 |
| 1340613 | N/A | N/A | 5832 | 5847 | ATGTTAGGACCCAGTC | 60 | 2087 |
| 1340661 | N/A | N/A | 9201 | 9216 | TACACTGACAACCCTT | 56 | 2088 |
| 1340665 | N/A | N/A | 14601 | 14616 | GAGAAATCTAAGAACC | 42 | 2089 |
| 1340667 | N/A | N/A | 9936 | 9951 | AATGAATCATGATTGA | 33 | 2090 |
| 1340669 | N/A | N/A | 10000 | 10015 | TGAAATCTTGTGTAAC | 43 | 2091 |
| 1340684 | N/A | N/A | 8125 | 8140 | AGTGCTTAGTTCATTG | 84 | 2092 |
| 1340685 | N/A | N/A | 16385 | 16400 | CAATCCCAACCAAACT | 49 | 2093 |
| 1340689 | N/A | N/A | 3600 | 3615 | CTTGGAAGGAGACTGG | 60 | 2094 |
| 1340697 | N/A | N/A | 4661 | 4676 | CCGCCCTTAAGTCATT | 53 | 2095 |
| 1340704 | N/A | N/A | 6329 | 6344 | ACTTTCATAGGGAGAC | 80 | 2096 |
| 1340705 | 74 | 89 | 3168 | 3183 | AAGGATTTCTAGGATG | 71 | 2097 |
| 1340722 | N/A | N/A | 5737 | 5752 | TTAGTTGGTAGCTTGC | 72 | 2098 |
| 1340767 | N/A | N/A | 9441 | 9456 | TCCCACAAAACTAACC | 24 | 2099 |
| 1340773 | N/A | N/A | 9773 | 9788 | TAGAACTCCCAACCCA | 44 | 2100 |
| 1340776 | N/A | N/A | 6732 | 6747 | TTACCCCTGGCTTTTC | 26 | 2101 |
| 1340785 | N/A | N/A | 7781 | 7796 | ACTACTTCAGTTAGCA | 79 | 2102 |
| 1340792 | N/A | N/A | 9115 | 9130 | GACAGACCAAGTAGCT | 39 | 2103 |
| 1340812 | N/A | N/A | 10264 | 10279 | CTTCCAAGCATTCCAT | 57 | 2104 |
| 1340813 | N/A | N/A | 7526 | 7541 | CCGAAAAAGTGGAGG | 31 | 2105 |
| 1340836 | N/A | N/A | 18694 | 18709 | AAGACTTTGAGACTCT | 62 | 2106 |
| 1340850 | N/A | N/A | 8744 | 8759 | CACTTTCACTGGGTGT | 7 | 2107 |
| 1340852 | 1424 | 1439 | 21239 | 21254 | TCCAGGTTGAGATAAA | 70 | 2108 |
| 1340872 | 1614 | 1629 | 21429 | 21444 | TCACCTTTCATAATGT | 63 | 2109 |
| 1340878 | N/A | N/A | 12627 | 12642 | TTGTTAAGCAGATGGC | 84 | 2110 |
| 1340889 | N/A | N/A | 6597 | 6612 | CTACTTTCAAACCTTG | 57 | 2111 |
| 1340903 | N/A | N/A | 20390 | 20405 | TGCTATAGTAATCACA | 65 | 2112 |

TABLE 30

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 84 | 121 |
| 1246023 | N/A | N/A | 5046 | 5061 | GAGTGAATCATTCAGT | 89 | 1526 |
| 1340078 | N/A | N/A | 16295 | 16310 | CCTTTAGTTAGAATAG | 37 | 2113 |

TABLE 30-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340094 | N/A | N/A | 19547 | 19562 | ATTGTTTAGCTGATAG | 61 | 2114 |
| 1340113 | N/A | N/A | 12667 | 12682 | TGTTAACCTGCAGCAG | 39 | 2115 |
| 1340122 | N/A | N/A | 14192 | 14207 | TGATTGAGTTCTCCAC | 48 | 2116 |
| 1340126 | N/A | N/A | 19779 | 19794 | ACATACCACTCTTCTC | 35 | 2117 |
| 1340130 | N/A | N/A | 17954 | 17969 | TTAGAAACTGCTCCTC | 48 | 2118 |
| 1340146 | N/A | N/A | 8132 | 8147 | TTGTTAGAGTGCTTAG | 76 | 2119 |
| 1340149 | N/A | N/A | 11545 | 11560 | CTTGACAATGGTTGCC | 58 | 2120 |
| 1340152 | N/A | N/A | 10138 | 10153 | ATAGATCCTTTTTGG | 6 | 2121 |
| 1340154 | N/A | N/A | 6284 | 6299 | ACATTCTTCAGGTGTT | 88 | 2122 |
| 1340156 | N/A | N/A | 20194 | 20209 | TTGCAGTTATTAGAAG | 13 | 2123 |
| 1340179 | N/A | N/A | 14315 | 14330 | TAAGATGTCCAGGCAT | 17 | 2124 |
| 1340197 | N/A | N/A | 10554 | 10569 | GAAGTGTAATGCTCCC | 71 | 2125 |
| 1340220 | N/A | N/A | 14611 | 14626 | TATTTCTTGCGAGAAA | 30 | 2126 |
| 1340241 | N/A | N/A | 16220 | 16235 | TTTATAGACTGGGTAG | 59 | 2127 |
| 1340255 | 1783 | 1798 | 21598 | 21613 | TTTCTTATGTAATAGC | 76 | 2128 |
| 1340260 | 1714 | 1729 | 21529 | 21544 | AAACATCTCTGGGACC | 76 | 2129 |
| 1340277 | N/A | N/A | 19914 | 19929 | AGTGCATCTTAAGATA | 57 | 2130 |
| 1340291 | N/A | N/A | 18540 | 18555 | GAAACTCACTTCCTAC | 56 | 2131 |
| 1340297 | N/A | N/A | 14917 | 14932 | AATACATTAGCAAGCT | 45 | 2132 |
| 1340304 | 697 | 712 | 12115 | 12130 | AGACATGAGGTTTTGA | 59 | 2133 |
| 1340310 | N/A | N/A | 13638 | 13653 | GACAATGTGCAGCTCT | 67 | 2134 |
| 1340321 | N/A | N/A | 6606 | 6621 | TAAAGCAGGCTACTTT | 9 | 2135 |
| 1340323 | N/A | N/A | 19396 | 19411 | CATAAGAGATGAGTAG | 44 | 2136 |
| 1340342 | N/A | N/A | 5279 | 5294 | GAGCTAGACAATTGCA | 73 | 2137 |
| 1340350 | N/A | N/A | 9716 | 9731 | TAGTGAACATACATTG | 23 | 2138 |
| 1340361 | N/A | N/A | 5935 | 5950 | GCTGCTATTTAGGGCA | 53 | 2139 |
| 1340364 | N/A | N/A | 5678 | 5693 | TTCTAGGTCAGTAGAG | 58 | 2140 |
| 1340369 | 1433 | 1448 | 21248 | 21263 | TAAAATATGTCCAGGT | 75 | 2141 |
| 1340385 | N/A | N/A | 4389 | 4404 | AGACCAAAAGATGGC | 80 | 2142 |
| 1340395 | N/A | N/A | 11794 | 11809 | AACTCTATTGATTGGC | 72 | 2143 |
| 1340416 | N/A | N/A | 12496 | 12511 | AATTCACCTTGACTAA | 9 | 2144 |
| 1340419 | N/A | N/A | 12410 | 12425 | ATCAAATGTATGTGCT | 73 | 2145 |
| 1340443 | N/A | N/A | 11117 | 11132 | CTACAGAGGAGTTTGC | 27 | 2146 |
| 1340445 | N/A | N/A | 5847 | 5862 | ACTCCCCAAACATGGA | 48 | 2147 |
| 1340458 | N/A | N/A | 7834 | 7849 | GCTGAGTGGATTACAT | 44 | 2148 |
| 1340469 | N/A | N/A | 6456 | 6471 | GTGCTAAGTAGTAATT | 58 | 2149 |

TABLE 30-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340476 | 815 | 830 | 15696 | 15711 | TTTCTTATTGGTAAGT | 44 | 2150 |
| 1340512 | N/A | N/A | 6736 | 6751 | GAGATTACCCCTGGCT | 72 | 2151 |
| 1340522 | N/A | N/A | 6915 | 6930 | ACTCGGGAAGTTTAGA | 26 | 2152 |
| 1340533 | N/A | N/A | 9456 | 9471 | GTTGATATTTCCATCT | 55 | 2153 |
| 1340543 | N/A | N/A | 20115 | 20130 | AGCATCAAGACATTCT | 79 | 2154 |
| 1340549 | N/A | N/A | 9968 | 9983 | AGTAGTGTAAGCTGAG | 88 | 2155 |
| 1340552 | N/A | N/A | 12802 | 12817 | CAGGCTGTAAGAGTCA | 56 | 2156 |
| 1340555 | N/A | N/A | 5158 | 5173 | GCCAAACTGCTACTGT | 73 | 2157 |
| 1340558 | N/A | N/A | 15423 | 15438 | ATATCCAGTAGGTGTG | 55 | 2158 |
| 1340606 | N/A | N/A | 18046 | 18061 | CAAGTTTGTTCATAGT | 78 | 2159 |
| 1340614 | 1311 | 1326 | 21126 | 21141 | TCTTAAACCTTCCCTG | 21 | 2160 |
| 1340651 | N/A | N/A | 9344 | 9359 | AAAGTGTCCTCGATCC | 36 | 2161 |
| 1340671 | N/A | N/A | 10293 | 10308 | TGAGAGAACTTATACA | 32 | 2162 |
| 1340673 | N/A | N/A | 5191 | 5206 | TATTCCCAACGCAACA | 62 | 2163 |
| 1340674 | N/A | N/A | 4663 | 4678 | ACCCGCCCTTAAGTCA | 48 | 2164 |
| 1340679 | N/A | N/A | 5758 | 5773 | ATAGGAGAGTCTTTCA | 77 | 2165 |
| 1340681 | N/A | N/A | 8547 | 8562 | GCACATCATGTTTTGC | 44 | 2166 |
| 1340683 | N/A | N/A | 9947 | 9962 | TACACCACACTAATGA | 26 | 2167 |
| 1340696 | N/A | N/A | 8656 | 8671 | CTCAGAGTTCAGGCAA | 67 | 2168 |
| 1340713 | N/A | N/A | 6191 | 6206 | GACAGAGCAATTTACT | 55 | 2169 |
| 1340734 | N/A | N/A | 8964 | 8979 | ACTCCGTTATAAGTTT | 42 | 2170 |
| 1340747 | 218 | 233 | 3312 | 3327 | AAATTCATAAGTAGTC | 39 | 2171 |
| 1340757 | N/A | N/A | 18143 | 18158 | CCTTATGTTATCTCAA | 67 | 2172 |
| 1340761 | N/A | N/A | 4068 | 4083 | CCTTACCAGAATTTAC | 63 | 2173 |
| 1340762 | N/A | N/A | 5651 | 5666 | CCAGAGCATTCATCAG | 83 | 2174 |
| 1340768 | N/A | N/A | 9210 | 9225 | GAAAGATGTACACTG | 56 | 2175 |
| 1340770 | N/A | N/A | 3505 | 3520 | CTAACCTGACACATAT | 18 | 2176 |
| 1340771 | 1179 | 1194 | 20994 | 21009 | TTTTTAAGAGGCATGA | 60 | 2177 |
| 1340775 | N/A | N/A | 9593 | 9608 | AAGAGCTGGTAAAGGT | 47 | 2178 |
| 1340798 | N/A | N/A | 3619 | 3634 | GACTTGCCTCATTTAG | 69 | 2179 |
| 1340802 | N/A | N/A | 9793 | 9808 | CCTATGCAAATTCATA | 34 | 2180 |
| 1340803 | N/A | N/A | 6333 | 6348 | AAGGACTTTCATAGGG | 71 | 2181 |
| 1340824 | N/A | N/A | 20421 | 20436 | CAGTAAAATTATGCCT | 38 | 2182 |
| 1340831 | N/A | N/A | 3702 | 3717 | AATTTTCAGATCCCGT | 74 | 2183 |
| 1340833 | N/A | N/A | 9117 | 9132 | AAGACAGACCAAGTAG | 16 | 2184 |
| 1340837 | N/A | N/A | 13955 | 13970 | ACCTCTAAGTTAGCCC | 28 | 2185 |

TABLE 30-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340845 | N/A | N/A | 18697 | 18712 | CAAAAGACTTTGAGAC | 22 | 2186 |
| 1340863 | N/A | N/A | 20598 | 20613 | AATACGCTGAGAGTTA | 48 | 2187 |
| 1340874 | N/A | N/A | 7528 | 7543 | TTCCGAAAAAAGTGGA | 13 | 2188 |
| 1340891 | N/A | N/A | 16895 | 16910 | CGTCAAATAGGGCTGG | 53 | 2189 |

TABLE 31

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 91 | 121 |
| 1246023 | N/A | N/A | 5046 | 5061 | GAGTGAATCATTCAGT | 83 | 1526 |
| 1340082 | N/A | N/A | 16329 | 16344 | CTTCACTATATTGCAT | 50 | 2190 |
| 1340083 | N/A | N/A | 20116 | 20131 | CAGCATCAAGACATTC | 72 | 2191 |
| 1340092 | N/A | N/A | 16221 | 16236 | TTTTATAGACTGGGTA | 53 | 2192 |
| 1340098 | N/A | N/A | 19818 | 19833 | ATAGTTCAAATTGGAT | 48 | 2193 |
| 1340125 | N/A | N/A | 15778 | 15793 | TGTTTTAGTATTTGGG | 48 | 2194 |
| 1340131 | N/A | N/A | 18720 | 18735 | CACCATGACAGCTTCA | 65 | 2195 |
| 1340141 | N/A | N/A | 11213 | 11228 | CTTCTGTAGGTTTTGC | 60 | 2196 |
| 1340142 | N/A | N/A | 17984 | 17999 | TAGTTATCTTCTCACT | 52 | 2197 |
| 1340148 | 2240 | 2255 | 22055 | 22070 | ATGCAAAAGCATTCTA | 50 | 2198 |
| 1340164 | N/A | N/A | 11546 | 11561 | TCTTGACAATGGTTGC | 77 | 2199 |
| 1340183 | N/A | N/A | 11795 | 11810 | TAACTCTATTGATTGG | 51 | 2200 |
| 1340187 | N/A | N/A | 20628 | 20643 | GACAACAGAGTTCTGT | 9 | 2201 |
| 1340192 | N/A | N/A | 12498 | 12513 | GAAATTCACCTTGACT | 41 | 2202 |
| 1340206 | 1330 | 1345 | 21145 | 21160 | TGGAATGCTACTTGAA | 85 | 2203 |
| 1340208 | N/A | N/A | 9969 | 9984 | GAGTAGTGTAAGCTGA | 80 | 2204 |
| 1340215 | N/A | N/A | 12416 | 12431 | ACGGTGATCAAATGTA | 53 | 2205 |
| 1340221 | N/A | N/A | 16900 | 16915 | AAAACCGTCAAATAGG | 28 | 2206 |
| 1340230 | N/A | N/A | 18658 | 18673 | TATTCTCCAACTCAGG | 54 | 2207 |
| 1340235 | N/A | N/A | 18145 | 18160 | CTCCTTATGTTATCTC | 57 | 2208 |
| 1340245 | N/A | N/A | 15446 | 15461 | TGTTATCAGAAACTTA | 44 | 2209 |
| 1340270 | N/A | N/A | 7550 | 7565 | GCTGTAATTAGGAAGA | 24 | 2210 |
| 1340274 | N/A | N/A | 10584 | 10599 | AGAACCAGGACTCTCC | 67 | 2211 |
| 1340275 | 219 | 234 | 3313 | 3328 | CAAATTCATAAGTAGT | 76 | 2212 |

TABLE 31-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340284 | 1467 | 1482 | 21282 | 21297 | AAGAGGCTAGGGAAAT | 66 | 2213 |
| 1340292 | N/A | N/A | 19417 | 19432 | GACAACTGATGTCCAG | 12 | 2214 |
| 1340312 | N/A | N/A | 20423 | 20438 | GACAGTAAAATTATGC | 57 | 2215 |
| 1340314 | N/A | N/A | 18075 | 18090 | TTGTACCCTGTTCTCA | 64 | 2216 |
| 1340320 | N/A | N/A | 14318 | 14333 | AATTAAGATGTCCAGG | 13 | 2217 |
| 1340324 | N/A | N/A | 9950 | 9965 | TTCTACACCACACTAA | 12 | 2218 |
| 1340329 | 1181 | 1196 | 20996 | 21011 | AGTTTTTAAGAGGCAT | 75 | 2219 |
| 1340337 | N/A | N/A | 13659 | 13674 | TCACAAAGTCCCTGAC | 11 | 2220 |
| 1340353 | N/A | N/A | 7125 | 7140 | CATGAAGATTAGTTAA | 11 | 2221 |
| 1340355 | N/A | N/A | 8657 | 8672 | TCTCAGAGTTCAGGCA | 54 | 2222 |
| 1340356 | N/A | N/A | 5680 | 5695 | GTTTCTAGGTCAGTAG | 73 | 2223 |
| 1340366 | N/A | N/A | 6457 | 6472 | AGTGCTAAGTAGTAAT | 71 | 2224 |
| 1340367 | N/A | N/A | 5870 | 5885 | TAAACCCTGGAGCAGC | 66 | 2225 |
| 1340370 | N/A | N/A | 5159 | 5174 | AGCCAAACTGCTACTG | 78 | 2226 |
| 1340426 | N/A | N/A | 9597 | 9612 | TGTGAAGAGCTGGTAA | 41 | 2227 |
| 1340472 | N/A | N/A | 6335 | 6350 | AGAAGGACTTTCATAG | 46 | 2228 |
| 1340475 | N/A | N/A | 8136 | 8151 | AAGTTTGTTAGAGTGC | 74 | 2229 |
| 1340484 | N/A | N/A | 12709 | 12724 | CCAGTAAAAAATTGGT | 23 | 2230 |
| 1340503 | N/A | N/A | 14613 | 14628 | ATTATTTCTTGCGAGA | 60 | 2231 |
| 1340514 | N/A | N/A | 9345 | 9360 | AAAAGTGTCCTCGATC | 17 | 2232 |
| 1340515 | N/A | N/A | 5762 | 5777 | AAGAATAGGAGAGTCT | 70 | 2233 |
| 1340539 | N/A | N/A | 3721 | 3736 | GACTTTTGTTTGTAGC | 74 | 2234 |
| 1340560 | N/A | N/A | 6285 | 6300 | TACATTCTTCAGGTGT | 61 | 2235 |
| 1340577 | N/A | N/A | 5280 | 5295 | TGAGCTAGACAATTGC | 78 | 2236 |
| 1340603 | 699 | 714 | 12117 | 12132 | AGAGACATGAGGTTTT | 77 | 2237 |
| 1340604 | N/A | N/A | 20195 | 20210 | ATTGCAGTTATTAGAA | 42 | 2238 |
| 1340617 | N/A | N/A | 3516 | 3531 | CCTTCATCTAACTAAC | 30 | 2239 |
| 1340636 | N/A | N/A | 12804 | 12819 | CTCAGGCTGTAAGAGT | 21 | 2240 |
| 1340647 | N/A | N/A | 5195 | 5210 | ACCGTATTCCCAACGC | 90 | 2241 |
| 1340659 | N/A | N/A | 8965 | 8980 | AACTCCGTTATAAGTT | 11 | 2242 |
| 1340664 | N/A | N/A | 3676 | 3691 | CCCCTAAGTTATTATC | 33 | 2243 |
| 1340690 | N/A | N/A | 9726 | 9741 | TGTGAGAGGATAGTGA | 50 | 2244 |
| 1340724 | N/A | N/A | 4862 | 4877 | AACTGAAACGATCCTC | 52 | 2245 |
| 1340725 | N/A | N/A | 9466 | 9481 | GGCAGTTGAAGTTGAT | 46 | 2246 |
| 1340727 | N/A | N/A | 8589 | 8604 | GTGGGATAAACTGTTC | 52 | 2247 |
| 1340746 | N/A | N/A | 19564 | 19579 | TAGCTATTGTCTTTGA | 63 | 2248 |

TABLE 31-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340781 | N/A | N/A | 13956 | 13971 | TACCTCTAAGTTAGCC | 28 | 2249 |
| 1340789 | N/A | N/A | 14193 | 14208 | GTGATTGAGTTCTCCA | 80 | 2250 |
| 1340790 | N/A | N/A | 9118 | 9133 | CAAGACAGACCAAGTA | 27 | 2251 |
| 1340830 | N/A | N/A | 7835 | 7850 | AGCTGAGTGGATTACA | 29 | 2252 |
| 1340834 | N/A | N/A | 6203 | 6218 | ATAGGACATGGAGACA | 82 | 2253 |
| 1340835 | N/A | N/A | 5653 | 5668 | TACCAGAGCATTCATC | 55 | 2254 |
| 1340838 | N/A | N/A | 10294 | 10309 | TTGAGAGAACTTATAC | 21 | 2255 |
| 1340839 | N/A | N/A | 19915 | 19930 | GAGTGCATCTTAAGAT | 43 | 2256 |
| 1340841 | N/A | N/A | 4069 | 4084 | GCCTTACCAGAATTTA | 75 | 2257 |
| 1340864 | N/A | N/A | 9796 | 9811 | AATCCTATGCAAATTC | 42 | 2258 |
| 1340865 | 1716 | 1731 | 21531 | 21546 | CTAAACATCTCTGGGA | 62 | 2259 |
| 1340870 | N/A | N/A | 4402 | 4417 | CGAATTTCTTCAAAGA | 55 | 2260 |
| 1340875 | N/A | N/A | 5974 | 5989 | AAAGCCCTATTCTTCG | 65 | 2261 |
| 1340876 | N/A | N/A | 6626 | 6641 | TGTACAGTAGGCAGTT | 75 | 2262 |
| 1340883 | N/A | N/A | 9224 | 9239 | CAAGTGACAGCATTGA | 48 | 2263 |
| 1340884 | N/A | N/A | 6738 | 6753 | ATGAGATTACCCCTGG | 62 | 2264 |
| 1340885 | N/A | N/A | 10184 | 10199 | AACACTAATCTCAGTA | 15 | 2265 |
| 1340892 | N/A | N/A | 14918 | 14933 | TAATACATTAGCAAGC | 33 | 2266 |

TABLE 32

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 59 | 121 |
| 1246023 | N/A | N/A | 5046 | 5061 | GAGTGAATCATTCAGT | 78 | 1526 |
| 1340075 | N/A | N/A | 13957 | 13972 | CTACCTCTAAGTTAGC | 6 | 2267 |
| 1340077 | 1468 | 1483 | 21283 | 21298 | GAAGAGGCTAGGGAAA | 44 | 2268 |
| 1340093 | N/A | N/A | 18744 | 18759 | TATACCTGTTGCCTAG | 11 | 2269 |
| 1340108 | N/A | N/A | 10848 | 10863 | CATATGGTGTACACTG | 15 | 2270 |
| 1340129 | N/A | N/A | 16904 | 16919 | GTCAAAACCGTCAAA | 39 | 2271 |
| 1340144 | 254 | 269 | 3348 | 3363 | AATATCCCACAGAACC | 60 | 2272 |
| 1340151 | N/A | N/A | 11796 | 11811 | ATAACTCTATTGATTG | 39 | 2273 |
| 1340157 | N/A | N/A | 9147 | 9162 | TGCCAAGCTTTGTGTC | 38 | 2274 |
| 1340163 | N/A | N/A | 14617 | 14632 | CCGAATTATTTCTTGC | 60 | 2275 |
| 1340166 | N/A | N/A | 4412 | 4427 | AAAGTTCATTCGAATT | 63 | 2276 |

TABLE 32-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340168 | N/A | N/A | 18086 | 18101 | ACCAATGCAGTTTGTA | 75 | 2277 |
| 1340169 | N/A | N/A | 6460 | 6475 | TAAAGTGCTAAGTAGT | 50 | 2278 |
| 1340171 | N/A | N/A | 11553 | 11568 | GTTTTTCTCTTGACAA | 59 | 2279 |
| 1340176 | N/A | N/A | 16117 | 16132 | GCTCTATTGGGCCAGG | 47 | 2280 |
| 1340181 | N/A | N/A | 18176 | 18191 | CGCGAGATGATGTTGC | 53 | 2281 |
| 1340211 | N/A | N/A | 18661 | 18676 | TACTATTCTCCAACTC | 47 | 2282 |
| 1340226 | 1182 | 1197 | 20997 | 21012 | AAGTTTTTAAGAGGCA | 77 | 2283 |
| 1340233 | N/A | N/A | 12499 | 12514 | AGAAATTCACCTTGAC | 39 | 2284 |
| 1340268 | N/A | N/A | 16224 | 16239 | TCTTTTTATAGACTGG | 82 | 2285 |
| 1340273 | N/A | N/A | 11237 | 11252 | GACATAGACATGTGTT | 26 | 2286 |
| 1340283 | 1717 | 1732 | 21532 | 21547 | TCTAAACATCTCTGGG | 40 | 2287 |
| 1340286 | N/A | N/A | 19846 | 19861 | AACCTATGTGTGCACC | 73 | 2288 |
| 1340327 | N/A | N/A | 12418 | 12433 | TAACGGTGATCAAATG | 17 | 2289 |
| 1340332 | N/A | N/A | 10295 | 10310 | TTTGAGAGAACTTATA | 0 | 2290 |
| 1340334 | N/A | N/A | 8973 | 8988 | AGTATGTGAACTCCGT | 81 | 2291 |
| 1340335 | N/A | N/A | 5654 | 5669 | TTACCAGAGCATTCAT | 50 | 2292 |
| 1340352 | N/A | N/A | 9970 | 9985 | TGAGTAGTGTAAGCTG | 62 | 2293 |
| 1340375 | N/A | N/A | 19444 | 19459 | TGGGATAGTGGAGGAA | 13 | 2294 |
| 1340377 | N/A | N/A | 17986 | 18001 | TATAGTTATCTTCTCA | 46 | 2295 |
| 1340386 | N/A | N/A | 14919 | 14934 | ATAATACATTAGCAAG | 7 | 2296 |
| 1340387 | N/A | N/A | 5873 | 5888 | GGCTAAACCCTGGAGC | 36 | 2297 |
| 1340388 | N/A | N/A | 8164 | 8179 | TATTGTAGGGATTGAA | 40 | 2298 |
| 1340397 | N/A | N/A | 3741 | 3756 | CTGTTGCAAGTTCTTC | 85 | 2299 |
| 1340398 | N/A | N/A | 13688 | 13703 | TTTACTCACTTCTGGT | 30 | 2300 |
| 1340415 | N/A | N/A | 12815 | 12830 | CACATAGCTAACTCAG | 42 | 2301 |
| 1340430 | N/A | N/A | 5197 | 5212 | GAACCGTATTCCCAAC | 72 | 2302 |
| 1340433 | N/A | N/A | 9467 | 9482 | AGGCAGTTGAAGTTGA | 47 | 2303 |
| 1340446 | N/A | N/A | 15491 | 15506 | TTAATGCCACCCTACC | 19 | 2304 |
| 1340450 | N/A | N/A | 5712 | 5727 | GATTGCACAAACCACA | 73 | 2305 |
| 1340451 | N/A | N/A | 6301 | 6316 | CTAGGAGATATAACAT | 40 | 2306 |
| 1340452 | N/A | N/A | 5978 | 5993 | CTGAAAAGCCCTATTC | 11 | 2307 |
| 1340454 | N/A | N/A | 7680 | 7695 | AATTTGTGAACCTGCA | 20 | 2308 |
| 1340468 | N/A | N/A | 20197 | 20212 | ACATTGCAGTTATTAG | 42 | 2309 |
| 1340471 | N/A | N/A | 14385 | 14400 | GCTTAGTGTAGAATTG | 16 | 2310 |
| 1340478 | N/A | N/A | 6740 | 6755 | CAATGAGATTACCCCT | 16 | 2311 |
| 1340489 | N/A | N/A | 6388 | 6403 | GATGATTCTGACTCAT | 55 | 2312 |

TABLE 32-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340498 | N/A | N/A | 20470 | 20485 | TCATTAGGAAAAGTGT | 16 | 2313 |
| 1340521 | N/A | N/A | 8593 | 8608 | AAAGGTGGGATAAACT | 33 | 2314 |
| 1340534 | N/A | N/A | 10187 | 10202 | GCCAACACTAATCTCA | 40 | 2315 |
| 1340545 | N/A | N/A | 20117 | 20132 | ACAGCATCAAGACATT | 53 | 2316 |
| 1340547 | N/A | N/A | 4864 | 4879 | TGAACTGAAACGATCC | 58 | 2317 |
| 1340554 | N/A | N/A | 9225 | 9240 | ACAAGTGACAGCATTG | 44 | 2318 |
| 1340566 | 700 | 715 | 12118 | 12133 | CAGAGACATGAGGTTT | 61 | 2319 |
| 1340574 | N/A | N/A | 9599 | 9614 | TATGTGAAGAGCTGGT | 63 | 2320 |
| 1340578 | N/A | N/A | 3678 | 3693 | ATCCCCTAAGTTATTA | 13 | 2321 |
| 1340585 | N/A | N/A | 5782 | 5797 | GGATTGCAGAAGAGTA | 76 | 2322 |
| 1340610 | N/A | N/A | 20629 | 20644 | TGACAACAGAGTTCTG | 11 | 2323 |
| 1340628 | N/A | N/A | 19585 | 19600 | TAAACTAAAGTACTTG | 1 | 2324 |
| 1340631 | N/A | N/A | 4071 | 4086 | TGGCCTTACCAGAATT | 46 | 2325 |
| 1340634 | N/A | N/A | 7127 | 7142 | GACATGAAGATTAGTT | 3 | 2326 |
| 1340638 | N/A | N/A | 9727 | 9742 | CTGTGAGAGGATAGTG | 33 | 2327 |
| 1340645 | 1352 | 1367 | 21167 | 21182 | ATTCTGTGGCATGGCT | 69 | 2328 |
| 1340668 | 2242 | 2257 | 22057 | 22072 | CCATGCAAAAGCATTC | 72 | 2329 |
| 1340701 | N/A | N/A | 3544 | 3559 | AATCGCTGCTTAGTTC | 41 | 2330 |
| 1340740 | N/A | N/A | 19999 | 20014 | CAGTTTTCCTCATGAT | 65 | 2331 |
| 1340777 | N/A | N/A | 14195 | 14210 | ATGTGATTGAGTTCTC | 36 | 2332 |
| 1340783 | N/A | N/A | 9915 | 9930 | CTATCTCCCTATTTGT | 15 | 2333 |
| 1340821 | N/A | N/A | 7942 | 7957 | GATCCATATTCCCTGA | 74 | 2334 |
| 1340822 | N/A | N/A | 5281 | 5296 | CTGAGCTAGACAATTG | 56 | 2335 |
| 1340832 | N/A | N/A | 8668 | 8683 | TGTATGAGGTCTCTCA | 66 | 2336 |
| 1340873 | N/A | N/A | 6221 | 6236 | CCAAACTTGCCCATAA | 45 | 2337 |
| 1340879 | N/A | N/A | 5161 | 5176 | AGAGCCAAACTGCTAC | 55 | 2338 |
| 1340894 | N/A | N/A | 9372 | 9387 | TAGAACACTTGCCTCA | 31 | 2339 |
| 1340895 | N/A | N/A | 9953 | 9968 | GAGTTCTACACCACAC | 76 | 2340 |
| 1340901 | N/A | N/A | 16332 | 16347 | CTACTTCACTATATTG | 33 | 2341 |
| 1340902 | N/A | N/A | 6628 | 6643 | GCTGTACAGTAGGCAG | 66 | 2342 |
| 1340910 | N/A | N/A | 12722 | 12737 | GATTAATTCCCTTCCA | 30 | 2343 |

TABLE 33

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 85 | 121 |
| 1246023 | N/A | N/A | 5046 | 5061 | GAGTGAATCATTCAGT | 79 | 1526 |
| 1340100 | N/A | N/A | 19467 | 19482 | CTGGAAGGAGGATTCA | 39 | 2344 |
| 1340117 | N/A | N/A | 12419 | 12434 | GTAACGGTGATCAAAT | 34 | 2345 |
| 1340119 | N/A | N/A | 9971 | 9986 | TTGAGTAGTGTAAGCT | 52 | 2346 |
| 1340123 | N/A | N/A | 9602 | 9617 | ACATATGTGAAGAGCT | 66 | 2347 |
| 1340127 | 1185 | 1200 | 21000 | 21015 | CAGAAGTTTTTAAGAG | 30 | 2348 |
| 1340135 | N/A | N/A | 19847 | 19862 | GAACCTATGTGTGCAC | 53 | 2349 |
| 1340145 | N/A | N/A | 6391 | 6406 | CTTGATGATTCTGACT | 57 | 2350 |
| 1340189 | N/A | N/A | 20479 | 20494 | TAGTGGACTTCATTAG | 52 | 2351 |
| 1340190 | N/A | N/A | 14921 | 14936 | CTATAATACATTAGCA | 3 | 2352 |
| 1340193 | N/A | N/A | 14618 | 14633 | CCCGAATTATTTCTTG | 34 | 2353 |
| 1340196 | N/A | N/A | 16225 | 16240 | CTCTTTTTATAGACTG | 63 | 2354 |
| 1340205 | N/A | N/A | 19586 | 19601 | GTAAACTAAAGTACTT | 0 | 2355 |
| 1340212 | N/A | N/A | 10930 | 10945 | ATAAGGCCGATTCATG | 38 | 2356 |
| 1340218 | N/A | N/A | 20001 | 20016 | ATCAGTTTTCCTCATG | 48 | 2357 |
| 1340228 | N/A | N/A | 20361 | 20376 | CTAAATTATTGCCTGA | 39 | 2358 |
| 1340229* | N/A | N/A | 20685 | 20700 | GAAGAAACCTGTACAA | 85 | 2359 |
| 1340234 | N/A | N/A | 16337 | 16352 | ATTAACTACTTCACTA | 14 | 2360 |
| 1340238 | N/A | N/A | 11855 | 11870 | TAAGCAGAATTGTGAA | 35 | 2361 |
| 1340244 | N/A | N/A | 16968 | 16983 | CCAATATATACTGACA | 68 | 2362 |
| 1340246 | N/A | N/A | 13959 | 13974 | GTCTACCTCTAAGTTA | 3 | 2363 |
| 1340258 | N/A | N/A | 11570 | 11585 | CTTGACAATGGTTGAT | 54 | 2364 |
| 1340266 | N/A | N/A | 18748 | 18763 | AATATATACCTGTTGC | 38 | 2365 |
| 1340271 | N/A | N/A | 17990 | 18005 | TTAGTATAGTTATCTT | 37 | 2366 |
| 1340309 | N/A | N/A | 14196 | 14211 | TATGTGATTGAGTTCT | 28 | 2367 |
| 1340311 | N/A | N/A | 18178 | 18193 | CTCGCGAGATGATGTT | 40 | 2368 |
| 1340339 | N/A | N/A | 6467 | 6482 | TAGGCAGTAAAGTGCT | 48 | 2369 |
| 1340345 | N/A | N/A | 18092 | 18107 | TGATACACCAATGCAG | 44 | 2370 |
| 1340348 | N/A | N/A | 5283 | 5298 | AACTGAGCTAGACAAT | 44 | 2371 |
| 1340349 | N/A | N/A | 6225 | 6240 | TGTACCAAACTTGCCC | 53 | 2372 |
| 1340354 | N/A | N/A | 9148 | 9163 | ATGCCAAGCTTTGTGT | 50 | 2373 |
| 1340357 | N/A | N/A | 3375 | 3390 | GTTGAAGATGTATAC | 53 | 2374 |
| 1340402 | N/A | N/A | 9958 | 9973 | GCTGAGAGTTCTACAC | 45 | 2375 |
| 1340406 | N/A | N/A | 8594 | 8609 | TAAAGGTGGGATAAAC | 0 | 2376 |
| 1340428 | N/A | N/A | 9921 | 9936 | AATTCACTATCTCCCT | 10 | 2377 |

TABLE 33-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340440 | 1360 | 1375 | 21175 | 21190 | TTGTTGATATTCTGTG | 52 | 2378 |
| 1340449 | N/A | N/A | 5198 | 5213 | TGAACCGTATTCCCAA | 76 | 2379 |
| 1340466 | N/A | N/A | 6638 | 6653 | TTGGTTGGAGGCTGTA | 60 | 2380 |
| 1340492 | N/A | N/A | 15497 | 15512 | GCTGCATTAATGCCAC | 46 | 2381 |
| 1340501 | N/A | N/A | 6742 | 6757 | TGCAATGAGATTACCC | 54 | 2382 |
| 1340504 | N/A | N/A | 12500 | 12515 | CAGAAATTCACCTTGA | 28 | 2383 |
| 1340505 | N/A | N/A | 6302 | 6317 | TCTAGGAGATATAACA | 48 | 2384 |
| 1340506 | N/A | N/A | 12758 | 12773 | GAGAATTGTTTAGTTC | 47 | 2385 |
| 1340548 | N/A | N/A | 5715 | 5730 | CCAGATTGCACAAACC | 72 | 2386 |
| 1340553 | N/A | N/A | 10188 | 10203 | TGCCAACACTAATCTC | 30 | 2387 |
| 1340571 | N/A | N/A | 9498 | 9513 | TGGAAGATTAATCATA | 12 | 2388 |
| 1340582 | 2243 | 2258 | 22058 | 22073 | TCCATGCAAAAGCATT | 62 | 2389 |
| 1340626 | N/A | N/A | 5657 | 5672 | AAGTTACCAGAGCATT | 70 | 2390 |
| 1340653 | N/A | N/A | 5984 | 5999 | GGATACCTGAAAAGCC | 68 | 2391 |
| 1340655 | 701 | 716 | 12119 | 12134 | GCAGAGACATGAGGTT | 55 | 2392 |
| 1340657 | N/A | N/A | 4076 | 4091 | TTTCATGGCCTTACCA | 52 | 2393 |
| 1340678 | N/A | N/A | 7130 | 7145 | TTGGACATGAAGATTA | 18 | 2394 |
| 1340692 | N/A | N/A | 3756 | 3771 | AGGCACTAAAGGTTTC | 61 | 2395 |
| 1340693 | N/A | N/A | 4476 | 4491 | GGACAAATGCCTGAGA | 52 | 2396 |
| 1340695 | N/A | N/A | 13689 | 13704 | GTTTACTCACTTCTGG | 29 | 2397 |
| 1340716 | N/A | N/A | 8168 | 8183 | GAGTTATTGTAGGGAT | 69 | 2398 |
| 1340723 | N/A | N/A | 8669 | 8684 | TTGTATGAGGTCTCTC | 50 | 2399 |
| 1340750 | N/A | N/A | 7682 | 7697 | GAAATTTGTGAACCTG | 32 | 2400 |
| 1340759 | N/A | N/A | 9755 | 9770 | CTACCTCCAAATTCCC | 27 | 2401 |
| 1340763 | N/A | N/A | 7947 | 7962 | GAAGTGATCCATATTC | 44 | 2402 |
| 1340786 | N/A | N/A | 12890 | 12905 | TCTTTAGTCAACAGTA | 68 | 2403 |
| 1340788 | N/A | N/A | 18667 | 18682 | CTGGGATACTATTCTC | 57 | 2404 |
| 1340800 | N/A | N/A | 14388 | 14403 | TAGGCTTAGTGTAGAA | 38 | 2405 |
| 1340805 | N/A | N/A | 9319 | 9334 | CCAAGTAATTACTTCT | 68 | 2406 |
| 1340807 | 1471 | 1486 | 21286 | 21301 | AAGGAAGAGGCTAGGG | 57 | 2407 |
| 1340808 | N/A | N/A | 5804 | 5819 | TCCCCTCAAATAGCCT | 60 | 2408 |
| 1340823 | N/A | N/A | 20119 | 20134 | TTACAGCATCAAGACA | 46 | 2409 |
| 1340842 | N/A | N/A | 16124 | 16139 | AATAATAGCTCTATTG | 0 | 2410 |
| 1340846 | N/A | N/A | 8981 | 8996 | TGTCCAGAAGTATGTG | 0 | 2411 |
| 1340857 | N/A | N/A | 5162 | 5177 | AAGAGCCAAACTGCTA | 63 | 2412 |
| 1340859 | N/A | N/A | 3568 | 3583 | TCAACCTGCACACCAT | 72 | 2413 |

TABLE 33-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340893 | N/A | N/A | 5876 | 5891 | GTAGGCTAAACCCTGG | 62 | 2414 |
| 1340896 | N/A | N/A | 11290 | 11305 | ATGTTTTGATCCAGGG | 46 | 2415 |
| 1340898 | 1720 | 1735 | 21535 | 21550 | TTGTCTAAACATCTCT | 60 | 2416 |
| 1340899 | N/A | N/A | 3679 | 3694 | CATCCCCTAAGTTATT | 24 | 2417 |
| 1340904 | N/A | N/A | 9381 | 9396 | CCATGGATCTAGAACA | 15 | 2418 |
| 1340905 | N/A | N/A | 10345 | 10360 | CGTTAGGTTTCCAAAT | 0 | 2419 |
| 1340908 | N/A | N/A | 5048 | 5063 | TAGAGTGAATCATTCA | 75 | 2420 |

TABLE 34

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 88 | 121 |
| 1246023 | N/A | N/A | 5046 | 5061 | GAGTGAATCATTCAGT | 86 | 1526 |
| 1340080 | N/A | N/A | 10970 | 10985 | TAATCTTGAGGCAGGA | 17 | 2421 |
| 1340088 | N/A | N/A | 12420 | 12435 | GGTAACGGTGATCAAA | 51 | 2422 |
| 1340111 | N/A | N/A | 9519 | 9534 | TCTACACTAATATTGA | 21 | 2423 |
| 1340121 | N/A | N/A | 14619 | 14634 | CCCCGAATTATTTCTT | 35 | 2424 |
| 1340132 | N/A | N/A | 16379 | 16394 | CAACCAAACTTCCAGC | 72 | 2425 |
| 1340133 | N/A | N/A | 12502 | 12517 | TGCAGAAATTCACCTT | 54 | 2426 |
| 1340160 | N/A | N/A | 8675 | 8690 | CTTCTATTGTATGAGG | 40 | 2427 |
| 1340175 | N/A | N/A | 11866 | 11881 | TCTTACATGATTAAGC | 35 | 2428 |
| 1340198 | N/A | N/A | 15019 | 15034 | TAAAATAGGGTGCAGT | 58 | 2429 |
| 1340199 | N/A | N/A | 20120 | 20135 | ATTACAGCATCAAGAC | 63 | 2430 |
| 1340200 | N/A | N/A | 14197 | 14212 | TTATGTGATTGAGTTC | 34 | 2431 |
| 1340222 | 734 | 749 | 12152 | 12167 | ATTTTTGGTGAACCCA | 8 | 2432 |
| 1340243 | N/A | N/A | 13690 | 13705 | CGTTTACTCACTTCTG | 21 | 2433 |
| 1340259 | N/A | N/A | 16126 | 16141 | ATAATAATAGCTCTAT | 1 | 2434 |
| 1340261 | 1197 | 1212 | 21012 | 21027 | TTTATGTAAGCACAGA | 70 | 2435 |
| 1340264 | 2247 | 2262 | 22062 | 22077 | ATAGTCCATGCAAAAG | 43 | 2436 |
| 1340269 | 1371 | 1386 | 21186 | 21201 | ATTCTGTGTTCTTGTT | 67 | 2437 |
| 1340280 | N/A | N/A | 17993 | 18008 | AAGTTAGTATAGTTAT | 20 | 2438 |
| 1340303 | N/A | N/A | 17014 | 17029 | TAGCAATTTAGCAAGA | 54 | 2439 |
| 1340307 | N/A | N/A | 11571 | 11586 | TCTTGACAATGGTTGA | 75 | 2440 |
| 1340318 | N/A | N/A | 19607 | 19622 | TATTATGCACTCTATA | 9 | 2441 |

TABLE 34-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340338 | N/A | N/A | 18672 | 18687 | TTTTACTGGGATACTA | 27 | 2442 |
| 1340347 | N/A | N/A | 9924 | 9939 | TTGAATTCACTATCTC | 45 | 2443 |
| 1340358 | N/A | N/A | 5199 | 5214 | TTGAACCGTATTCCCA | 76 | 2444 |
| 1340363 | N/A | N/A | 9975 | 9990 | ACAGTTGAGTAGTGTA | 72 | 2445 |
| 1340396 | N/A | N/A | 20002 | 20017 | AATCAGTTTTCCTCAT | 53 | 2446 |
| 1340400 | N/A | N/A | 20483 | 20498 | TTCATAGTGGACTTCA | 51 | 2447 |
| 1340418 | N/A | N/A | 20378 | 20393 | CACAAGTAAGGTAAAG | 54 | 2448 |
| 1340425 | N/A | N/A | 6747 | 6762 | CTAGTTGCAATGAGAT | 65 | 2449 |
| 1340431 | N/A | N/A | 10199 | 10214 | GGTAAGCCCCATGCCA | 38 | 2450 |
| 1340437 | N/A | N/A | 11307 | 11322 | CACAAGCACACTGTAA | 2 | 2451 |
| 1340455 | N/A | N/A | 5716 | 5731 | GCCAGATTGCACAAAC | 60 | 2452 |
| 1340462 | N/A | N/A | 16262 | 16277 | GCAGAGACAGTAGATT | 63 | 2453 |
| 1340470 | N/A | N/A | 6228 | 6243 | TTATGTACCAAACTTG | 53 | 2454 |
| 1340493 | N/A | N/A | 5985 | 6000 | AGGATACCTGAAAAGC | 81 | 2455 |
| 1340508 | N/A | N/A | 14392 | 14407 | AACATAGGCTTAGTGT | 18 | 2456 |
| 1340510 | N/A | N/A | 4103 | 4118 | ATCCTGTAAACACTTC | 79 | 2457 |
| 1340513 | N/A | N/A | 7949 | 7964 | AGGAAGTGATCCATAT | 60 | 2458 |
| 1340518 | N/A | N/A | 9004 | 9019 | AGGCAAAGATCTGGCC | 7 | 2459 |
| 1340519 | N/A | N/A | 9386 | 9401 | GCACCCCATGGATCTA | 35 | 2460 |
| 1340524 | 1544 | 1559 | 21359 | 21374 | TTCAGAGTTATACAGA | 66 | 2461 |
| 1340527 | N/A | N/A | 3680 | 3695 | CCATCCCCTAAGTTAT | 14 | 2462 |
| 1340544 | 1022 | 1037 | 20837 | 20852 | CTTTGCAGCATTGATT | 47 | 2463 |
| 1340561 | N/A | N/A | 3782 | 3797 | GAACTGTGTTGCTTGT | 77 | 2464 |
| 1340570 | N/A | N/A | 19887 | 19902 | TACGACAGGTCATCTT | 58 | 2465 |
| 1340572 | N/A | N/A | 6426 | 6441 | ATGGTAAACTGTATGC | 78 | 2466 |
| 1340575 | N/A | N/A | 9606 | 9621 | ATTCACATATGTGAAG | 0 | 2467 |
| 1340588 | N/A | N/A | 4481 | 4496 | TTTTTGGACAAATGCC | 50 | 2468 |
| 1340609 | N/A | N/A | 7683 | 7698 | AGAAATTTGTGAACCT | 39 | 2469 |
| 1340620 | N/A | N/A | 18963 | 18978 | ATGCAAGATTTACTTC | 38 | 2470 |
| 1340640 | N/A | N/A | 5049 | 5064 | TTAGAGTGAATCATTC | 69 | 2471 |
| 1340642 | N/A | N/A | 6308 | 6323 | TGCTACTCTAGGAGAT | 60 | 2472 |
| 1340648 | N/A | N/A | 5809 | 5824 | CAGTATCCCCTCAAAT | 53 | 2473 |
| 1340650 | 1722 | 1737 | 21537 | 21552 | AATTGTCTAAACATCT | 62 | 2474 |
| 1340670 | N/A | N/A | 8170 | 8185 | CAGAGTTATTGTAGGG | 83 | 2475 |
| 1340680 | N/A | N/A | 5169 | 5184 | ATTGCATAAGAGCCAA | 67 | 2476 |
| 1340687 | 519 | 534 | 10405 | 10420 | GAAGAAGTGCTTTTGT | 50 | 2477 |

TABLE 34-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340691 | N/A | N/A | 9757 | 9772 | AGCTACCTCCAAATTC | 0 | 2478 |
| 1340700 | N/A | N/A | 14077 | 14092 | AACAACCCAGCCTCGG | 20 | 2479 |
| 1340711 | N/A | N/A | 9959 | 9974 | AGCTGAGAGTTCTACA | 67 | 2480 |
| 1340717 | N/A | N/A | 3569 | 3584 | ATCAACCTGCACACCA | 63 | 2481 |
| 1340742 | N/A | N/A | 19472 | 19487 | TATAACTGGAAGGAGG | 44 | 2482 |
| 1340744 | N/A | N/A | 12780 | 12795 | TCAAATGAGGCGGCAC | 46 | 2483 |
| 1340749 | N/A | N/A | 6710 | 6725 | GGAATGCTCATATTAA | 19 | 2484 |
| 1340753 | N/A | N/A | 15498 | 15513 | TGCTGCATTAATGCCA | 15 | 2485 |
| 1340756 | N/A | N/A | 5284 | 5299 | TAACTGAGCTAGACAA | 53 | 2486 |
| 1340765 | N/A | N/A | 9152 | 9167 | GTACATGCCAAGCTTT | 61 | 2487 |
| 1340778 | N/A | N/A | 6468 | 6483 | ATAGGCAGTAAAGTGC | 56 | 2488 |
| 1340828 | N/A | N/A | 8600 | 8615 | CTGTCATAAAGGTGGG | 59 | 2489 |
| 1340840 | N/A | N/A | 9320 | 9335 | TCCAAGTAATTACTTC | 72 | 2490 |
| 1340843 | N/A | N/A | 18505 | 18520 | CTAATTTAGTCAACTT | 40 | 2491 |
| 1340848 | N/A | N/A | 5658 | 5673 | TAAGTTACCAGAGCAT | 77 | 2492 |
| 1340861 | N/A | N/A | 3429 | 3444 | GATGGTAAGTCAAATA | 85 | 2493 |
| 1340871 | N/A | N/A | 7426 | 7441 | TTGGCCGAGGAGGGCG | 3 | 2494 |
| 1340909 | N/A | N/A | 13548 | 13563 | TCTAAAGGGCTGCTCT | 33 | 2495 |
| 1340913 | N/A | N/A | 5883 | 5898 | CGCTACTGTAGGCTAA | 68 | 2496 |
| 1340916 | N/A | N/A | 18094 | 18109 | ATTGATACACCAATGC | 66 | 2497 |

TABLE 35

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 84 | 121 |
| 1246023 | N/A | N/A | 5046 | 5061 | GAGTGAATCATTCAGT | 81 | 1526 |
| 1340081 | 1028 | 1043 | 20843 | 20858 | ATAAAGCTTTGCAGCA | 54 | 2498 |
| 1340090 | N/A | N/A | 9961 | 9976 | TAAGCTGAGAGTTCTA | 64 | 2499 |
| 1340106 | N/A | N/A | 19473 | 19488 | CTATAACTGGAAGGAG | 43 | 2500 |
| 1340110 | N/A | N/A | 17228 | 17243 | TGTACAAATTTATGCC | 67 | 2501 |
| 1340114 | 565 | 580 | 10451 | 10466 | GAAGCCACTGTGACGA | 58 | 2502 |
| 1340118 | N/A | N/A | 9608 | 9623 | CAATTCACATATGTGA | 11 | 2503 |
| 1340128 | N/A | N/A | 14461 | 14476 | AGGTATGTCATACTTC | 5 | 2504 |

TABLE 35-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340143 | N/A | N/A | 15021 | 15036 | GATAAAATAGGGTGCA | 52 | 2505 |
| 1340150 | N/A | N/A | 15501 | 15516 | ATTTGCTGCATTAATG | 20 | 2506 |
| 1340165 | N/A | N/A | 14198 | 14213 | ATTATGTGATTGAGTT | 46 | 2507 |
| 1340177 | N/A | N/A | 3682 | 3697 | GCCCATCCCCTAAGTT | 33 | 2508 |
| 1340185 | N/A | N/A | 14621 | 14636 | TGCCCCGAATTATTTC | 3 | 2509 |
| 1340191 | N/A | N/A | 19890 | 19905 | GCTTACGACAGGTCAT | 73 | 2510 |
| 1340195 | N/A | N/A | 16127 | 16142 | CATAATAATAGCTCTA | 41 | 2511 |
| 1340210 | N/A | N/A | 18969 | 18984 | TGACTAATGCAAGATT | 45 | 2512 |
| 1340223 | N/A | N/A | 13729 | 13744 | TTAAGTACTGTGAGAC | 35 | 2513 |
| 1340254 | N/A | N/A | 13563 | 13578 | GTTCAACTGAACCTCT | 55 | 2514 |
| 1340265 | N/A | N/A | 11897 | 11912 | TGAGAGTATAAATGGC | 67 | 2515 |
| 1340272 | N/A | N/A | 11576 | 11591 | TATTCTCTTGACAATG | 47 | 2516 |
| 1340294 | N/A | N/A | 19651 | 19666 | TTCTATGCAAGCCTTC | 51 | 2517 |
| 1340300 | N/A | N/A | 17998 | 18013 | TTATGAAGTTAGTATA | 31 | 2518 |
| 1340302 | N/A | N/A | 18509 | 18524 | GACACTAATTTAGTCA | 11 | 2519 |
| 1340319 | 2248 | 2263 | 22063 | 22078 | GATAGTCCATGCAAAA | 64 | 2520 |
| 1340322 | 735 | 750 | 12153 | 12168 | GATTTTTGGTGAACCC | 30 | 2521 |
| 1340336 | N/A | N/A | 9925 | 9940 | ATTGAATTCACTATCT | 31 | 2522 |
| 1340372 | N/A | N/A | 5988 | 6003 | GCAAGGATACCTGAAA | 67 | 2523 |
| 1340373 | N/A | N/A | 6309 | 6324 | CTGCTACTCTAGGAGA | 66 | 2524 |
| 1340379 | N/A | N/A | 18095 | 18110 | AATTGATACACCAATG | 55 | 2525 |
| 1340382 | N/A | N/A | 3570 | 3585 | TATCAACCTGCACACC | 62 | 2526 |
| 1340384 | N/A | N/A | 18673 | 18688 | ATTTTACTGGGATACT | 49 | 2527 |
| 1340394 | N/A | N/A | 12503 | 12518 | TTGCAGAAATTCACCT | 36 | 2528 |
| 1340401 | N/A | N/A | 5664 | 5679 | AGAGCATAAGTTACCA | 88 | 2529 |
| 1340404 | N/A | N/A | 9977 | 9992 | AGACAGTTGAGTAGTG | 63 | 2530 |
| 1340414 | N/A | N/A | 7954 | 7969 | AAACTAGGAAGTGATC | 39 | 2531 |
| 1340422 | N/A | N/A | 5202 | 5217 | TTTTTGAACCGTATTC | 56 | 2532 |
| 1340429 | N/A | N/A | 16275 | 16290 | CAGCAAAGTTTGGGCA | 37 | 2533 |
| 1340434 | N/A | N/A | 20121 | 20136 | GATTACAGCATCAAGA | 52 | 2534 |
| 1340435 | N/A | N/A | 3784 | 3799 | TAGAACTGTGTTGCTT | 78 | 2535 |
| 1340482 | 1199 | 1214 | 21014 | 21029 | TGTTTATGTAAGCACA | 74 | 2536 |
| 1340496 | N/A | N/A | 8605 | 8620 | GAACACTGTCATAAAG | 43 | 2537 |
| 1340499 | N/A | N/A | 20380 | 20395 | ATCACAAGTAAGGTAA | 62 | 2538 |
| 1340500 | N/A | N/A | 16380 | 16395 | CCAACCAAACTTCCAG | 70 | 2539 |
| 1340526 | N/A | N/A | 10974 | 10989 | ATTGTAATCTTGAGGC | 39 | 2540 |

TABLE 35-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340529 | N/A | N/A | 9158 | 9173 | CTCCTGGTACATGCCA | 47 | 2541 |
| 1340538 | N/A | N/A | 6428 | 6443 | TAATGGTAAACTGTAT | 32 | 2542 |
| 1340584 | N/A | N/A | 6748 | 6763 | CCTAGTTGCAATGAGA | 77 | 2543 |
| 1340587 | N/A | N/A | 12422 | 12437 | GTGGTAACGGTGATCA | 49 | 2544 |
| 1340590 | N/A | N/A | 6711 | 6726 | GGGAATGCTCATATTA | 18 | 2545 |
| 1340594 | N/A | N/A | 9057 | 9072 | TGTCAGAGACTCTGTG | 39 | 2546 |
| 1340607 | N/A | N/A | 7708 | 7723 | CGTCCTAGGAAACAAA | 45 | 2547 |
| 1340619 | N/A | N/A | 8236 | 8251 | CTACATGACCTGGGTC | 59 | 2548 |
| 1340630 | N/A | N/A | 4133 | 4148 | GGAGTACTTCACAATT | 79 | 2549 |
| 1340646 | N/A | N/A | 5170 | 5185 | GATTGCATAAGAGCCA | 82 | 2550 |
| 1340654 | N/A | N/A | 5810 | 5825 | TCAGTATCCCCTCAAA | 64 | 2551 |
| 1340677 | N/A | N/A | 8706 | 8721 | GGACCAATATAATCCA | 20 | 2552 |
| 1340706 | N/A | N/A | 9323 | 9338 | ACATCCAAGTAATTAC | 56 | 2553 |
| 1340731 | N/A | N/A | 5717 | 5732 | TGCCAGATTGCACAAA | 54 | 2554 |
| 1340737 | N/A | N/A | 20486 | 20501 | AACTTCATAGTGGACT | 68 | 2555 |
| 1340741 | N/A | N/A | 14165 | 14180 | GCAAGCCAACAGAGAG | 52 | 2556 |
| 1340748 | N/A | N/A | 11384 | 11399 | TTTAGTCAGGTAGAGT | 30 | 2557 |
| 1340751 | N/A | N/A | 9411 | 9426 | TGTATAGCTGCATTTC | 37 | 2558 |
| 1340772 | N/A | N/A | 5886 | 5901 | TTTCGCTACTGTAGGC | 62 | 2559 |
| 1340780 | N/A | N/A | 5054 | 5069 | CAGCCTTAGAGTGAAT | 82 | 2560 |
| 1340782 | N/A | N/A | 4537 | 4552 | GAGATTTGAAGGTTAG | 82 | 2561 |
| 1340804 | N/A | N/A | 20005 | 20020 | AGTAATCAGTTTTCCT | 65 | 2562 |
| 1340811 | 1546 | 1561 | 21361 | 21376 | ACTTCAGAGTTATACA | 35 | 2563 |
| 1340815 | N/A | N/A | 7473 | 7488 | CATTCGGCTAGGCGCG | 46 | 2564 |
| 1340816 | N/A | N/A | 9759 | 9774 | CAAGCTACCTCCAAAT | 25 | 2565 |
| 1340817 | 1372 | 1387 | 21187 | 21202 | CATTCTGTGTTCTTGT | 60 | 2566 |
| 1340820 | N/A | N/A | 3432 | 3447 | GTAGATGGTAAGTCAA | 86 | 2567 |
| 1340826 | 1723 | 1738 | 21538 | 21553 | AAATTGTCTAAACATC | 24 | 2568 |
| 1340847 | N/A | N/A | 6246 | 6261 | ACTGGATGGATTTCTC | 83 | 2569 |
| 1340854 | N/A | N/A | 10201 | 10216 | ATGGTAAGCCCCATGC | 22 | 2570 |
| 1340855 | N/A | N/A | 6471 | 6486 | GTAATAGGCAGTAAAG | 77 | 2571 |
| 1340866 | N/A | N/A | 12794 | 12809 | AAGAGTCAGTATCCTC | 63 | 2572 |
| 1340877 | N/A | N/A | 9521 | 9536 | ATTCTACACTAATATT | 0 | 2573 |
| 1340880 | N/A | N/A | 5285 | 5300 | ATAACTGAGCTAGACA | 71 | 2574 |

TABLE 36

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 89 | 121 |
| 1246023 | N/A | N/A | 5046 | 5061 | GAGTGAATCATTCAGT | 91 | 1526 |
| 1340087 | N/A | N/A | 11578 | 11593 | GTTATTCTCTTGACAA | 42 | 2575 |
| 1340089 | N/A | N/A | 11388 | 11403 | AACTTTTAGTCAGGTA | 49 | 2576 |
| 1340116 | N/A | N/A | 16381 | 16396 | CCCAACCAAACTTCCA | 62 | 2577 |
| 1340124 | 603 | 618 | 10489 | 10504 | ATGGGATGAGGTAAGG | 46 | 2578 |
| 1340136 | N/A | N/A | 13782 | 13797 | ACAATCAGGAGTTGCA | 62 | 2579 |
| 1340153 | N/A | N/A | 5223 | 5238 | TTAGCTTAAACTCCAA | 78 | 2580 |
| 1340162 | N/A | N/A | 12504 | 12519 | CTTGCAGAAATTCACC | 40 | 2581 |
| 1340188 | N/A | N/A | 19489 | 19504 | CATCTAGAATTAAGGG | 53 | 2582 |
| 1340203 | N/A | N/A | 18690 | 18705 | CTTTGAGACTCTTGTT | 61 | 2583 |
| 1340207 | N/A | N/A | 18002 | 18017 | AGGCTTATGAAGTTAG | 57 | 2584 |
| 1340216 | N/A | N/A | 18971 | 18986 | GTTGACTAATGCAAGA | 59 | 2585 |
| 1340225 | N/A | N/A | 18096 | 18111 | AAATTGATACACCAAT | 14 | 2586 |
| 1340227 | N/A | N/A | 19891 | 19906 | TGCTTACGACAGGTCA | 81 | 2587 |
| 1340232 | N/A | N/A | 19656 | 19671 | ATCCATTCTATGCAAG | 46 | 2588 |
| 1340240 | 1397 | 1412 | 21212 | 21227 | AAACTTGATCTCTTAG | 61 | 2589 |
| 1340248 | 1726 | 1741 | 21541 | 21556 | CTAAAATTGTCTAAAC | 35 | 2590 |
| 1340262 | N/A | N/A | 12423 | 12438 | GGTGGTAACGGTGATC | 31 | 2591 |
| 1340281 | N/A | N/A | 20122 | 20137 | TGATTACAGCATCAAG | 69 | 2592 |
| 1340285 | 2249 | 2264 | 22064 | 22079 | GGATAGTCCATGCAAA | 64 | 2593 |
| 1340293 | 1597 | 1612 | 21412 | 21427 | TCTTATAAGACTATAA | 17 | 2594 |
| 1340299 | N/A | N/A | 14905 | 14920 | AGCTAAGAGACACTTC | 41 | 2595 |
| 1340313 | N/A | N/A | 13568 | 13583 | GAACAGTTCAACTGAA | 10 | 2596 |
| 1340326 | 1054 | 1069 | 20869 | 20884 | TATTATCAGGACTGAA | 63 | 2597 |
| 1340328 | N/A | N/A | 20382 | 20397 | TAATCACAAGTAAGGT | 54 | 2598 |
| 1340331 | N/A | N/A | 8707 | 8722 | GGGACCAATATAATCC | 31 | 2599 |
| 1340351 | N/A | N/A | 9194 | 9209 | ACAACCCTTAACAAAC | 26 | 2600 |
| 1340371 | N/A | N/A | 6479 | 6494 | CCAACTATGTAATAGG | 68 | 2601 |
| 1340378 | N/A | N/A | 9982 | 9997 | TATTAAGACAGTTGAG | 44 | 2602 |
| 1340407 | N/A | N/A | 4140 | 4155 | TTCTCAAGGAGTACTT | 76 | 2603 |
| 1340417 | N/A | N/A | 9422 | 9437 | TATATGAGGTCTGTAT | 42 | 2604 |
| 1340436 | N/A | N/A | 9765 | 9780 | CCAACCCAAGCTACCT | 15 | 2605 |
| 1340441 | N/A | N/A | 5812 | 5827 | AGTCAGTATCCCCTCA | 82 | 2606 |
| 1340442 | N/A | N/A | 5718 | 5733 | CTGCCAGATTGCACAA | 44 | 2607 |
| 1340485 | N/A | N/A | 5058 | 5073 | ATTACAGCCTTAGAGT | 56 | 2608 |

TABLE 36-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340486 | N/A | N/A | 3571 | 3586 | CTATCAACCTGCACAC | 39 | 2609 |
| 1340487 | N/A | N/A | 6749 | 6764 | GCCTAGTTGCAATGAG | 61 | 2610 |
| 1340509 | N/A | N/A | 7476 | 7491 | TAACATTCGGCTAGGC | 52 | 2611 |
| 1340511 | N/A | N/A | 3933 | 3948 | CTGCGCACATATTTTA | 92 | 2612 |
| 1340516 | N/A | N/A | 5667 | 5682 | TAGAGAGCATAAGTTA | 59 | 2613 |
| 1340523 | N/A | N/A | 9927 | 9942 | TGATTGAATTCACTAT | N.D. | 2614 |
| 1340536 | N/A | N/A | 11924 | 11939 | CCAAAAATCAGCCACT | 0 | 2615 |
| 1340550 | N/A | N/A | 7768 | 7783 | GCAGCTAAAATCCAAT | 70 | 2616 |
| 1340557 | N/A | N/A | 17672 | 17687 | AACCTTTGTTGCCTGG | 36 | 2617 |
| 1340559 | N/A | N/A | 14462 | 14477 | GAGGTATGTCATACTT | 29 | 2618 |
| 1340562 | N/A | N/A | 15510 | 15525 | TATTCCAGGATTTGCT | 43 | 2619 |
| 1340564 | N/A | N/A | 3435 | 3450 | TAAGTAGATGGTAAGT | 74 | 2620 |
| 1340581 | N/A | N/A | 8613 | 8628 | GGCCAAGGGAACACTG | 36 | 2621 |
| 1340589 | 1200 | 1215 | 21015 | 21030 | ATGTTTATGTAAGCAC | 70 | 2622 |
| 1340591 | N/A | N/A | 3693 | 3708 | ATCCCGTTCTTGCCCA | 30 | 2623 |
| 1340593 | N/A | N/A | 12169 | 12184 | CCTTACCTTGTGCTTG | 20 | 2624 |
| 1340595 | N/A | N/A | 8017 | 8032 | ATCTCACAAGGGAAAT | 73 | 2625 |
| 1340596 | N/A | N/A | 6435 | 6450 | CTAGTGGTAATGGTAA | 62 | 2626 |
| 1340602 | N/A | N/A | 10206 | 10221 | TTGGTATGGTAAGCCC | 62 | 2627 |
| 1340605 | N/A | N/A | 5286 | 5301 | TATAACTGAGCTAGAC | 53 | 2628 |
| 1340621 | N/A | N/A | 9327 | 9342 | ATATACATCCAAGTAA | 18 | 2629 |
| 1340622 | N/A | N/A | 6247 | 6262 | CACTGGATGGATTTCT | 72 | 2630 |
| 1340641 | N/A | N/A | 5176 | 5191 | AGTTTAGATTGCATAA | 50 | 2631 |
| 1340644 | N/A | N/A | 16282 | 16297 | TAGTCTTCAGCAAAGT | 49 | 2632 |
| 1340652 | N/A | N/A | 14168 | 14183 | ATAGCAAGCCAACAGA | 37 | 2633 |
| 1340675 | N/A | N/A | 14201 | 14216 | ATTATTATGTGATTGA | 39 | 2634 |
| 1340682 | N/A | N/A | 9525 | 9540 | CTAGATTCTACACTAA | 17 | 2635 |
| 1340688 | N/A | N/A | 9629 | 9644 | TAGTTTGGTGGGCATG | 28 | 2636 |
| 1340699 | N/A | N/A | 20487 | 20502 | TAACTTCATAGTGGAC | 76 | 2637 |
| 1340707 | N/A | N/A | 16130 | 16145 | CTCCATAATAATAGCT | 59 | 2638 |
| 1340710 | N/A | N/A | 9962 | 9977 | GTAAGCTGAGAGTTCT | 49 | 2639 |
| 1340736 | N/A | N/A | 4640 | 4655 | TACGACTTCCTTCTAA | 67 | 2640 |
| 1340774 | N/A | N/A | 15212 | 15227 | CCATAAAGCTGGATTG | 40 | 2641 |
| 1340779 | N/A | N/A | 5992 | 6007 | AGAGGCAAGGATACCT | 78 | 2642 |
| 1340797 | N/A | N/A | 18517 | 18532 | AGTACCAAGACACTAA | 66 | 2643 |
| 1340814 | N/A | N/A | 8237 | 8252 | ACTACATGACCTGGGT | 54 | 2644 |

TABLE 36-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340818 | N/A | N/A | 9077 | 9092 | ACTTGAATTCTGTGTC | 52 | 2645 |
| 1340849 | N/A | N/A | 6316 | 6331 | GACCATGCTGCTACTC | 74 | 2646 |
| 1340853 | N/A | N/A | 10978 | 10993 | CAGCATTGTAATCTTG | 43 | 2647 |
| 1340858 | N/A | N/A | 6715 | 6730 | GCCAGGGAATGCTCAT | 38 | 2648 |
| 1340860 | N/A | N/A | 12796 | 12811 | GTAAGAGTCAGTATCC | 47 | 2649 |
| 1340886 | N/A | N/A | 5888 | 5903 | TATTTCGCTACTGTAG | 48 | 2650 |
| 1340887 | N/A | N/A | 20009 | 20024 | AGAGAGTAATCAGTTT | 39 | 2651 |

TABLE 37

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 83 | 121 |
| 1246023 | N/A | N/A | 5046 | 5061 | GAGTGAATCATTCAGT | 76 | 1526 |
| 1340073 | N/A | N/A | 12797 | 12812 | TGTAAGAGTCAGTATC | 43 | 2652 |
| 1340074 | 1203 | 1218 | 21018 | 21033 | AGTATGTTTATGTAAG | 48 | 2653 |
| 1340084 | N/A | N/A | 18692 | 18707 | GACTTTGAGACTCTTG | 65 | 2654 |
| 1340091 | N/A | N/A | 9333 | 9348 | GATCCTATATACATCC | 49 | 2655 |
| 1340101 | N/A | N/A | 11391 | 11406 | TGCAACTTTTAGTCAG | 41 | 2656 |
| 1340103 | N/A | N/A | 16383 | 16398 | ATCCCAACCAAACTTC | 15 | 2657 |
| 1340140 | 605 | 620 | 10491 | 10506 | ATATGGGATGAGGTAA | 37 | 2658 |
| 1340159 | N/A | N/A | 6029 | 6044 | TTCCGTCTCACAATCT | 79 | 2659 |
| 1340174 | N/A | N/A | 13571 | 13586 | TCAGAACAGTTCAACT | 30 | 2660 |
| 1340178 | 1598 | 1613 | 21413 | 21428 | ATCTTATAAGACTATA | 32 | 2661 |
| 1340202 | N/A | N/A | 19658 | 19673 | GAATCCATTCTATGCA | 47 | 2662 |
| 1340217 | N/A | N/A | 11579 | 11594 | AGTTATTCTCTTGACA | 48 | 2663 |
| 1340236 | N/A | N/A | 20491 | 20506 | GACATAACTTCATAGT | 39 | 2664 |
| 1340237 | N/A | N/A | 16131 | 16146 | GCTCCATAATAATAGC | 21 | 2665 |
| 1340250 | N/A | N/A | 12170 | 12185 | ACCTTACCTTGTGCTT | 0 | 2666 |
| 1340252 | N/A | N/A | 18518 | 18533 | TAGTACCAAGACACTA | 27 | 2667 |
| 1340253 | N/A | N/A | 18003 | 18018 | AAGGCTTATGAAGTTA | 61 | 2668 |
| 1340317 | N/A | N/A | 18098 | 18113 | TGAAATTGATACACCA | 58 | 2669 |
| 1340376 | N/A | N/A | 5304 | 5319 | CGGCCTATTCTTCTGT | 25 | 2670 |
| 1340389 | N/A | N/A | 7478 | 7493 | ATTAACATTCGGCTAG | 17 | 2671 |
| 1340392 | N/A | N/A | 19498 | 19513 | AATATCAGCCATCTAG | 24 | 2672 |

TABLE 37-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340410 | 1074 | 1089 | 20889 | 20904 | TGCCAAACCAATGTTT | 32 | 2673 |
| 1340413 | N/A | N/A | 9195 | 9210 | GACAACCCTTAACAAA | 24 | 2674 |
| 1340447 | N/A | N/A | 3436 | 3451 | ATAAGTAGATGGTAAG | 58 | 2675 |
| 1340461 | N/A | N/A | 17676 | 17691 | TCAAAACCTTTGTTGC | 6 | 2676 |
| 1340463 | N/A | N/A | 6716 | 6731 | TGCCAGGGAATGCTCA | 23 | 2677 |
| 1340464 | N/A | N/A | 9647 | 9662 | ATGTATGAGGTCTCCG | 63 | 2678 |
| 1340477 | N/A | N/A | 13824 | 13839 | ACCAAGAGGGTTTTTA | 7 | 2679 |
| 1340495 | N/A | N/A | 4648 | 4663 | ATTTTTAATACGACTT | 35 | 2680 |
| 1340497 | N/A | N/A | 9963 | 9978 | TGTAAGCTGAGAGTTC | 45 | 2681 |
| 1340507 | N/A | N/A | 9766 | 9781 | CCCAACCCAAGCTACC | 22 | 2682 |
| 1340517 | N/A | N/A | 18983 | 18998 | CACTTTGGTATTGTTG | 53 | 2683 |
| 1340528 | N/A | N/A | 8636 | 8651 | GACTGTTGAGCTCAAA | 52 | 2684 |
| 1340537 | N/A | N/A | 5669 | 5684 | AGTAGAGAGCATAAGT | 52 | 2685 |
| 1340540 | N/A | N/A | 8040 | 8055 | GACTACATTAACACCA | 58 | 2686 |
| 1340541 | N/A | N/A | 6438 | 6453 | AAACTAGTGGTAATGG | 47 | 2687 |
| 1340568 | N/A | N/A | 20123 | 20138 | CTGATTACAGCATCAA | 40 | 2688 |
| 1340573 | N/A | N/A | 6762 | 6777 | CTTGAGAGTGATTGCC | 64 | 2689 |
| 1340579 | 2250 | 2265 | 22065 | 22080 | AGGATAGTCCATGCAA | 64 | 2690 |
| 1340592 | N/A | N/A | 10218 | 10233 | GATACAAATTTATTGG | 33 | 2691 |
| 1340598 | N/A | N/A | 5720 | 5735 | CACTGCCAGATTGCAC | 38 | 2692 |
| 1340608 | N/A | N/A | 3575 | 3590 | CTTTCTATCAACCTGC | 68 | 2693 |
| 1340615 | N/A | N/A | 14475 | 14490 | AGTATGACAACTGGAG | 15 | 2694 |
| 1340616 | N/A | N/A | 20046 | 20061 | CGTAACCATGCATTAA | 68 | 2695 |
| 1340618 | N/A | N/A | 6248 | 6263 | CCACTGGATGGATTTC | 68 | 2696 |
| 1340624 | N/A | N/A | 7772 | 7787 | GTTAGCAGCTAAAATC | 45 | 2697 |
| 1340635 | N/A | N/A | 5814 | 5829 | AAAGTCAGTATCCCCT | 77 | 2698 |
| 1340649 | N/A | N/A | 4222 | 4237 | TCAACTAAACATGACA | 77 | 2699 |
| 1340660 | N/A | N/A | 9933 | 9948 | GAATCATGATTGAATT | 39 | 2700 |
| 1340672 | N/A | N/A | 3695 | 3710 | AGATCCCGTTCTTGCC | 68 | 2701 |
| 1340676 | N/A | N/A | 5182 | 5197 | CGCAACAGTTTAGATT | 57 | 2702 |
| 1340703 | N/A | N/A | 14911 | 14926 | TTAGCAAGCTAAGAGA | 42 | 2703 |
| 1340708 | N/A | N/A | 12424 | 12439 | GGGTGGTAACGGTGAT | 46 | 2704 |
| 1340712 | N/A | N/A | 3952 | 3967 | CAAGGAAAAGCCTGAC | 59 | 2705 |
| 1340715 | N/A | N/A | 8256 | 8271 | CTGGTTTCATAACCTA | 9 | 2706 |
| 1340718 | N/A | N/A | 9423 | 9438 | TTATATGAGGTCTGTA | 32 | 2707 |
| 1340730 | N/A | N/A | 8709 | 8724 | TTGGGACCAATATAAT | 18 | 2708 |

TABLE 37-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340738 | N/A | N/A | 11965 | 11980 | TGTGAGAAGGCGGTAT | 20 | 2709 |
| 1340743 | N/A | N/A | 5890 | 5905 | TGTATTTCGCTACTGT | 76 | 2710 |
| 1340754 | N/A | N/A | 16284 | 16299 | AATAGTCTTCAGCAAA | 48 | 2711 |
| 1340758 | N/A | N/A | 19904 | 19919 | AAGATACCCAGGTTGC | 59 | 2712 |
| 1340784 | N/A | N/A | 5226 | 5241 | GCTTTAGCTTAAACTC | 72 | 2713 |
| 1340787 | N/A | N/A | 9081 | 9096 | GTCCACTTGAATTCTG | 18 | 2714 |
| 1340799 | N/A | N/A | 5066 | 5081 | TGAGTTACATTACAGC | 90 | 2715 |
| 1340825 | 1748 | 1763 | 21563 | 21578 | GTGTTAGCTTTAATTT | 48 | 2716 |
| 1340844 | 1398 | 1413 | 21213 | 21228 | GAAACTTGATCTCTTA | 64 | 2717 |
| 1340851 | N/A | N/A | 9528 | 9543 | GCCCTAGATTCTACAC | 15 | 2718 |
| 1340868 | N/A | N/A | 15214 | 15229 | TTCCATAAAGCTGGAT | 5 | 2719 |
| 1340869 | N/A | N/A | 11073 | 11088 | TACAACCTGGTTTCAT | 25 | 2720 |
| 1340881 | N/A | N/A | 6321 | 6336 | AGGGAGACCATGCTGC | 79 | 2721 |
| 1340888 | N/A | N/A | 6480 | 6495 | ACCAACTATGTAATAG | 47 | 2722 |
| 1340890 | N/A | N/A | 14204 | 14219 | CAGATTATTATGTGAT | 51 | 2723 |
| 1340900 | N/A | N/A | 9989 | 10004 | GTAACTGTATTAAGAC | 54 | 2724 |
| 1340906 | N/A | N/A | 12506 | 12521 | TTCTTGCAGAAATTCA | 42 | 2725 |
| 1340912 | N/A | N/A | 14169 | 14184 | AATAGCAAGCCAACAG | 9 | 2726 |
| 1340914 | N/A | N/A | 20384 | 20399 | AGTAATCACAAGTAAG | 54 | 2727 |
| 1340915 | 794 | 809 | 15675 | 15690 | ATCTATCAGACTTCTT | 47 | 2728 |

TABLE 38

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1245927 | N/A | N/A | 3433 | 3448 | AGTAGATGGTAAGTCA | 84 | 121 |
| 1246023 | N/A | N/A | 5046 | 5061 | GAGTGAATCATTCAGT | 91 | 1526 |
| 1340076 | N/A | N/A | 12426 | 12441 | CAGGGTGGTAACGGTG | 55 | 2729 |
| 1340079 | N/A | N/A | 12191 | 12206 | ACCCATTCTAACTTGA | 0 | 2730 |
| 1340105 | N/A | N/A | 13825 | 13840 | TACCAAGAGGGTTTTT | 17 | 2731 |
| 1340107 | N/A | N/A | 12798 | 12813 | CTGTAAGAGTCAGTAT | 42 | 2732 |
| 1340112 | N/A | N/A | 20493 | 20508 | TTGACATAACTTCATA | 15 | 2733 |
| 1340115 | N/A | N/A | 12003 | 12018 | TGTTAGCTAAGGGAGA | 0 | 2734 |
| 1340139 | N/A | N/A | 17768 | 17783 | CAGCATATTCATTTGG | 49 | 2735 |

TABLE 38-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340147 | N/A | N/A | 5831 | 5846 | TGTTAGGACCCAGTCT | 51 | 2736 |
| 1340161 | N/A | N/A | 6764 | 6779 | TTCTTGAGAGTGATTG | 52 | 2737 |
| 1340167 | N/A | N/A | 4659 | 4674 | GCCCTTAAGTCATTTT | 25 | 2738 |
| 1340173 | N/A | N/A | 11075 | 11090 | ATTACAACCTGGTTTC | 50 | 2739 |
| 1340184 | N/A | N/A | 14913 | 14928 | CATTAGCAAGCTAAGA | 0 | 2740 |
| 1340186 | N/A | N/A | 13576 | 13591 | CACTATCAGAACAGTT | 24 | 2741 |
| 1340214 | N/A | N/A | 14173 | 14188 | CTTGAATAGCAAGCCA | 25 | 2742 |
| 1340219 | N/A | N/A | 18519 | 18534 | TTAGTACCAAGACACT | 41 | 2743 |
| 1340224 | N/A | N/A | 20109 | 20124 | AAGACATTCTAGCCTG | 63 | 2744 |
| 1340242 | N/A | N/A | 12616 | 12631 | ATGGCTTAATTTTCGG | 33 | 2745 |
| 1340251 | N/A | N/A | 20190 | 20205 | AGTTATTAGAAGTCAG | 54 | 2746 |
| 1340257 | N/A | N/A | 20386 | 20401 | ATAGTAATCACAAGTA | 56 | 2747 |
| 1340267 | 1749 | 1764 | 21564 | 21579 | TGTGTTAGCTTTAATT | 38 | 2748 |
| 1340296 | N/A | N/A | 14476 | 14491 | GAGTATGACAACTGGA | 23 | 2749 |
| 1340298 | 808 | 823 | 15689 | 15704 | TTGGTAAGTATTCCAT | 20 | 2750 |
| 1340316 | 1175 | 1190 | 20990 | 21005 | TAAGAGGCATGAAAGG | 52 | 2751 |
| 1340325 | N/A | N/A | 8713 | 8728 | AGTTTTGGGACCAATA | 31 | 2752 |
| 1340343 | N/A | N/A | 11580 | 11595 | GAGTTATTCTCTTGAC | 57 | 2753 |
| 1340344 | N/A | N/A | 7479 | 7494 | AATTAACATTCGGCTA | 38 | 2754 |
| 1340365 | N/A | N/A | 16384 | 16399 | AATCCCAACCAAACTT | 23 | 2755 |
| 1340374 | N/A | N/A | 19673 | 19688 | CAAGAGACACCACCAG | 50 | 2756 |
| 1340381 | N/A | N/A | 6439 | 6454 | TAAACTAGTGGTAATG | 14 | 2757 |
| 1340383 | N/A | N/A | 5894 | 5909 | CCTTTGTATTTCGCTA | 47 | 2758 |
| 1340408 | N/A | N/A | 6326 | 6341 | TTCATAGGGAGACCAT | 65 | 2759 |
| 1340421 | N/A | N/A | 9964 | 9979 | GTGTAAGCTGAGAGTT | 60 | 2760 |
| 1340424 | N/A | N/A | 10499 | 10514 | ACTTACCAATATGGGA | 0 | 2761 |
| 1340457 | N/A | N/A | 15247 | 15262 | ATAGCTAAGTATACTT | 0 | 2762 |
| 1340480 | N/A | N/A | 18102 | 18117 | ATACTGAAATTGATAC | 11 | 2763 |
| 1340481 | N/A | N/A | 9651 | 9666 | GCTAATGTATGAGGTC | 78 | 2764 |
| 1340483 | N/A | N/A | 9112 | 9127 | AGACCAAGTAGCTTAC | 42 | 2765 |
| 1340488 | N/A | N/A | 5070 | 5085 | GATCTGAGTTACATTA | 69 | 2766 |
| 1340502 | N/A | N/A | 9999 | 10014 | GAAATCTTGTGTAACT | 69 | 2767 |
| 1340535 | N/A | N/A | 9198 | 9213 | ACTGACAACCCTTAAC | 10 | 2768 |
| 1340551 | N/A | N/A | 16285 | 16300 | GAATAGTCTTCAGCAA | 51 | 2769 |
| 1340569 | N/A | N/A | 8050 | 8065 | TTCTACAGAAGACTAC | 40 | 2770 |
| 1340583 | N/A | N/A | 9432 | 9447 | ACTAACCAATTATATG | 6 | 2771 |

TABLE 38-continued

Inhibition of HSD17B13 RNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | % Inhibition | SEQ ID NO |
|---|---|---|---|---|---|---|---|
| 1340611 | N/A | N/A | 16132 | 16147 | TGCTCCATAATAATAG | 35 | 2772 |
| 1340623 | 1603 | 1618 | 21418 | 21433 | AATGTATCTTATAAGA | 10 | 2773 |
| 1340632 | N/A | N/A | 18998 | 19013 | AGTCATATTGAAAATC | 39 | 2774 |
| 1340637 | N/A | N/A | 7773 | 7788 | AGTTAGCAGCTAAAAT | 33 | 2775 |
| 1340639 | N/A | N/A | 5185 | 5200 | CAACGCAACAGTTTAG | 52 | 2776 |
| 1340656 | N/A | N/A | 10258 | 10273 | AGCATTCCATGATTAA | 47 | 2777 |
| 1340658 | N/A | N/A | 18005 | 18020 | CCAAGGCTTATGAAGT | 27 | 2778 |
| 1340662 | N/A | N/A | 8279 | 8294 | TCTAAAGTGCTGGTTG | 34 | 2779 |
| 1340663 | N/A | N/A | 6482 | 6497 | GCACCAACTATGTAAT | 53 | 2780 |
| 1340666 | N/A | N/A | 3697 | 3712 | TCAGATCCCGTTCTTG | 59 | 2781 |
| 1340702 | N/A | N/A | 3584 | 3599 | CTCCTGAGTCTTTCTA | 23 | 2782 |
| 1340714 | N/A | N/A | 5227 | 5242 | TGCTTTAGCTTAAACT | 51 | 2783 |
| 1340720 | N/A | N/A | 19531 | 19546 | GCTAAAATGGTCATCT | 40 | 2784 |
| 1340721 | 2356 | 2371 | 22171 | 22186 | TTTATAACTACAAGAG | 38 | 2785 |
| 1340732 | N/A | N/A | 8639 | 8654 | ACAGACTGTTGAGCTC | 53 | 2786 |
| 1340733 | 1254 | 1269 | 21069 | 21084 | TTTTGTCCACCTTTAA | 68 | 2787 |
| 1340735 | N/A | N/A | 9334 | 9349 | CGATCCTATATACATC | 33 | 2788 |
| 1340745 | N/A | N/A | 9767 | 9782 | TCCCAACCCAAGCTAC | 8 | 2789 |
| 1340760 | N/A | N/A | 19905 | 19920 | TAAGATACCCAGGTTG | 39 | 2790 |
| 1340764 | N/A | N/A | 3478 | 3493 | GACCAGGGAATTTATC | 41 | 2791 |
| 1340766 | N/A | N/A | 9934 | 9949 | TGAATCATGATTGAAT | 38 | 2792 |
| 1340793 | N/A | N/A | 5646 | 5661 | GCATTCATCAGATGTT | 89 | 2793 |
| 1340794 | N/A | N/A | 6717 | 6732 | CTGCCAGGGAATGCTC | 23 | 2794 |
| 1340796 | N/A | N/A | 6033 | 6048 | ACTTTTCCGTCTCACA | 89 | 2795 |
| 1340806 | N/A | N/A | 5671 | 5686 | TCAGTAGAGAGCATAA | 52 | 2796 |
| 1340809 | 1417 | 1432 | 21232 | 21247 | TGAGATAAAGCTGCCT | 63 | 2797 |
| 1340827 | N/A | N/A | 5732 | 5747 | TGGTAGCTTGCTCACT | 71 | 2798 |
| 1340829 | N/A | N/A | 6249 | 6264 | GCCACTGGATGGATTT | 36 | 2799 |
| 1340856 | N/A | N/A | 11392 | 11407 | CTGCAACTTTTAGTCA | 21 | 2800 |
| 1340862 | N/A | N/A | 9530 | 9545 | CTGCCCTAGATTCTAC | 33 | 2801 |
| 1340867 | N/A | N/A | 14263 | 14278 | GAGTTAGGGAGCCAGC | 39 | 2802 |
| 1340882 | N/A | N/A | 4223 | 4238 | TTCAACTAAACATGAC | 55 | 2803 |
| 1340897 | N/A | N/A | 18693 | 18708 | AGACTTTGAGACTCTT | 57 | 2804 |
| 1340911 | N/A | N/A | 3988 | 4003 | GTTTACAAGTAAGAAC | 42 | 2805 |

Modified oligonucleotides complementary to an HSD17B13 nucleic acid with other chemistry modifications were synthesized and tested for their effect on HSD17B13 RNA levels in vitro, as described above. The Chemistry Notation column in the Tables below specifies the chemistry of each modified oligonucleotide; wherein subscript 'd' represents a 2'-β-D-deoxyribosyl sugar moiety, subscript 'e' represents a 2'-MOE sugar moiety, subscript 'y' represents a 2'-O-methyl sugar moiety, subscript 'k' represents a cEt modified sugar moiety, subscript 's' represents a phosphorothioate internucleoside linkage, and superscript 'm' before the cytosine residue represents a 5-methyl cytosine.

TABLE 39

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % Inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^mC_{ks}A_k$ | 78 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 78 | 1526 |
| 1341171 | 700 | 715 | 12118 | 12133 | CAGAGACATGAGGTTT | ${}^mC_{ks}A_{ks}G_{ds}A_{ds}G_{ds}A_{ds}{}^mC_{ds}A_{ds}T_{ds}G_{ds}A_{ks}G_{ks}G_{es}T_{ks}T_{es}T_k$ | 61 | 2319 |
| 1341175 | 794 | 809 | 15675 | 15690 | ATCTATCAGACTTCTT | $A_{ks}T_{ks}{}^mC_{ds}T_{ds}A_{ds}T_{ds}{}^mC_{ds}A_{ds}G_{ds}A_{ds}{}^mC_{ds}T_{ks}T_{es}{}^mC_{ks}T_{es}T_k$ | 37 | 2728 |
| 1341179 | 606 | 621 | 10492 | 10507 | AATATGGGATGAGGTA | $A_{ks}A_{ks}T_{ds}A_{ds}T_{ds}G_{ds}G_{ds}G_{ds}A_{ds}T_{ds}G_{ds}A_{ks}G_{es}G_{ks}T_{es}A_k$ | 52 | 1424 |
| 1341180 | 1080 | 1095 | 20895 | 20910 | TGCTAGTGCCAAACCA | $T_{ks}G_{ks}{}^mC_{ds}T_{ds}A_{ds}G_{ds}T_{ds}G_{ds}{}^mC_{ds}{}^mC_{ds}A_{ds}A_{ks}A_{es}{}^mC_{ks}{}^mC_{es}A_k$ | 58 | 1432 |
| 1341189 | 1019 | 1034 | 20834 | 20849 | TGCAGCATTGATTCGA | $T_{ks}G_{ks}{}^mC_{ds}A_{ds}G_{ds}{}^mC_{ds}A_{ds}T_{ds}T_{ds}G_{ds}A_{ds}T_{ks}T_{es}{}^mC_{ks}G_{es}A_k$ | 42 | 419 |
| 1341190 | 1258 | 1273 | 21073 | 21088 | TAGCTTTTGTCCACCT | $T_{ks}A_{ks}G_{ds}{}^mC_{ds}T_{ds}T_{ds}T_{ds}T_{ds}G_{ds}T_{ds}{}^mC_{ds}{}^mC_{ks}A_{es}{}^mC_{ks}{}^mC_{es}T_k$ | 71 | 1900 |
| 1341193 | 1202 | 1217 | 21017 | 21032 | GTATGTTTATGTAAGC | $G_{ks}T_{ks}A_{ds}T_{ds}G_{ds}T_{ds}T_{ds}T_{ds}A_{ds}T_{ds}G_{ds}T_{ks}A_{es}A_{ks}G_{es}{}^mC_k$ | 72 | 1511 |
| 1341198 | 1084 | 1099 | 20899 | 20914 | CTGCTGCTAGTGCCAA | ${}^mC_{ks}T_{ks}G_{ds}{}^mC_{ds}T_{ds}G_{ds}{}^mC_{ds}T_{ds}A_{ds}G_{ds}T_{ds}G_{ks}{}^mC_{es}{}^mC_{ks}A_{es}A_k$ | 44 | 1743 |
| 1341200 | 1316 | 1331 | 21131 | 21146 | AACAGTCTTAAACCTT | $A_{ks}A_{ks}{}^mC_{ds}A_{ds}G_{ds}T_{ds}{}^mC_{ds}T_{ds}T_{ds}A_{ds}A_{ds}A_{ks}{}^mC_{es}{}^mC_{ks}T_{es}T_k$ | 37 | 188 |
| 1341213 | 1324 | 1339 | 21139 | 21154 | GCTACTTGAACAGTCT | $G_{ks}{}^mC_{ks}T_{ds}A_{ds}{}^mC_{ds}T_{ds}T_{ds}G_{ds}A_{ds}A_{ds}{}^mC_{ds}A_{ks}G_{es}T_{ks}{}^mC_{es}T_k$ | 64 | 811 |
| 1341217 | 1312 | 1327 | 21127 | 21142 | GTCTTAAACCTTCCCT | $G_{ks}T_{ks}{}^mC_{ds}T_{ds}T_{ds}A_{ds}A_{ds}A_{ds}{}^mC_{ds}{}^mC_{ds}T_{ds}T_{ks}{}^mC_{es}{}^mC_{ks}{}^mC_{es}T_k$ | 28 | 1901 |
| 1341228 | 1333 | 1348 | 21148 | 21163 | GATTGGAATGCTACTT | $G_{ks}A_{ks}T_{ds}T_{ds}G_{ds}G_{ds}A_{ds}A_{ds}T_{ds}G_{ds}{}^mC_{ds}T_{ks}A_{es}{}^mC_{ks}T_{es}T_k$ | 53 | 1435 |
| 1341234 | 1356 | 1371 | 21171 | 21186 | TGATATTCTGTGGCAT | $T_{ks}G_{ks}A_{ds}T_{ds}A_{ds}T_{ds}T_{ds}{}^mC_{ds}T_{ds}G_{ds}T_{ds}G_{ks}G_{es}{}^mC_{ks}A_{es}T_k$ | 46 | 1124 |
| 1341236 | 1352 | 1367 | 21167 | 21182 | ATTCTGTGGCATGGCT | $A_{ks}T_{ks}T_{ds}{}^mC_{ds}T_{ds}G_{ds}T_{ds}G_{ds}G_{ds}{}^mC_{ds}A_{ds}T_{ks}G_{es}G_{ks}{}^mC_{es}T_k$ | 55 | 2328 |
| 1341239 | 1340 | 1355 | 21155 | 21170 | GGCTACAGATTGGAAT | $G_{ks}G_{ks}{}^mC_{ds}T_{ds}A_{ds}{}^mC_{ds}A_{ds}G_{ds}A_{ds}T_{ds}T_{ds}G_{ks}G_{es}A_{ks}A_{es}T_k$ | 73 | 1980 |
| 1341241 | 1387 | 1402 | 21202 | 21217 | TCTTAGCTGTGCACTC | $T_{ks}{}^mC_{ks}T_{ds}T_{ds}A_{ds}G_{ds}{}^mC_{ds}T_{ds}G_{ds}T_{ds}G_{ds}{}^mC_{ks}A_{es}{}^mC_{ks}T_{es}{}^mC_k$ | 50 | 190 |
| 1341247 | 1364 | 1379 | 21179 | 21194 | GTTCTTGTTGATATTC | $G_{ks}T_{ks}T_{ds}{}^mC_{ds}T_{ds}T_{ds}G_{ds}T_{ds}T_{ds}G_{ds}A_{ds}T_{ks}A_{es}T_{ks}T_{es}{}^mC_k$ | 66 | 1436 |
| 1341250 | 1393 | 1408 | 21208 | 21223 | TTGATCTCTTAGCTGT | $T_{ks}T_{ks}G_{ds}A_{ds}T_{ds}{}^mC_{ds}T_{ds}{}^mC_{ds}T_{ds}T_{ds}A_{ds}G_{ks}{}^mC_{es}T_{ks}G_{es}T_k$ | 38 | 658 |
| 1341258 | 1420 | 1435 | 21235 | 21250 | GGTTGAGATAAAGCTG | $G_{ks}G_{ks}T_{ds}T_{ds}G_{ds}A_{ds}G_{ds}A_{ds}T_{ds}A_{ds}A_{ds}A_{ks}G_{es}{}^mC_{ks}T_{es}G_k$ | 60 | 1826 |

TABLE 39-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % Inhibition | SEQ ID NO |
|---|---|---|---|---|---|---|---|---|
| 1341263 | 1489 | 1504 | 21304 | 21319 | CGTTTTGGGCTAATGA | $^mC_{ks}G_{ks}T_{ds}T_{ds}T_{ds}T_{ds}G_{ds}G_{ds}G_{ds}^mC_{ds}T_{ds}A_{ds}A_{es}T_{ks}G_{es}A_k$ | 37 | 1282 |
| 1341267 | 1493 | 1508 | 21308 | 21323 | GCACCGTTTTGGGCTA | $G_{ks}^mC_{ks}A_{ds}^mC_{ds}^mC_{ds}G_{ds}T_{ds}T_{ds}T_{ds}T_{ds}G_{ds}G_{ks}G_{es}^mC_{ks}T_{es}A_k$ | 49 | 1593 |
| 1341274 | 1497 | 1512 | 21312 | 21327 | AGTTGCACCGTTTTGG | $A_{ks}G_{ks}T_{ds}T_{ds}G_{ds}^mC_{ds}A_{ds}^mC_{ds}^mC_{ds}G_{ds}T_{ds}T_{ks}T_{es}T_{ks}G_{es}G_k$ | 41 | 1905 |
| 1341280 | 1622 | 1637 | 21437 | 21452 | AGAGTCGGTCACCTTT | $A_{ks}G_{ds}A_{ds}G_{ds}T_{ds}^mC_{ds}G_{ds}G_{ds}T_{ds}^mC_{ds}A_{ds}^mC_{ks}^mC_{es}T_{ks}T_{es}T_k$ | 61 | 428 |
| 1341281 | 1630 | 1645 | 21445 | 21460 | TTTAAAATAGAGTCGG | $T_{ks}T_{ks}T_{ds}A_{ds}A_{ds}A_{ds}A_{ds}T_{ds}A_{ds}G_{ds}A_{ds}G_{ks}T_{es}^mC_{ks}G_{es}G_k$ | 43 | 1051 |
| 1341287 | 1618 | 1633 | 21433 | 21448 | TCGGTCACCTTTCATA | $T_{ks}^mC_{ks}G_{ds}G_{ds}T_{ds}^mC_{ds}A_{ds}^mC_{ds}^mC_{ds}T_{ds}T_{ds}T_{ks}^mC_{es}A_{ks}T_{es}A_k$ | 63 | 116 |
| 1341290 | 1626 | 1641 | 21441 | 21456 | AAATAGAGTCGGTCAC | $A_{ks}A_{ks}A_{ds}T_{ds}A_{ds}G_{ds}A_{ds}G_{ds}T_{ds}^mC_{ds}G_{ds}G_{ks}T_{es}^mC_{ks}A_{es}^mC_k$ | 50 | 740 |
| 1341296 | 1714 | 1729 | 21529 | 21544 | AAACATCTCTGGGACC | $A_{ks}A_{ks}A_{ds}^mC_{ds}A_{ds}^mC_{ds}T_{ds}^mC_{ds}T_{ds}G_{ds}G_{ks}G_{es}A_{ks}^mC_{es}^mC_k$ | 36 | 2129 |
| 1341297 | 1710 | 1725 | 21525 | 21540 | ATCTCTGGGACCAAGG | $A_{ks}T_{ks}^mC_{ds}T_{ds}^mC_{ds}T_{ds}G_{ds}G_{ds}G_{ds}A_{ds}^mC_{ds}^mC_{ks}A_{es}A_{ks}G_{es}G_k$ | 65 | 37 |
| 1341303 | 1768 | 1783 | 21583 | 21598 | CCAGTACAGTTCCTTT | $^mC_{ks}^mC_{ks}A_{ds}G_{ds}T_{ds}A_{ds}^mC_{ds}A_{ds}G_{ds}T_{ds}T_{ds}^mC_{ks}^mC_{es}T_{ks}T_{es}T_k$ | 75 | 1753 |
| 1341305 | 1750 | 1765 | 21565 | 21580 | CTGTGTTAGCTTTAAT | $^mC_{ks}T_{ks}G_{ds}T_{ds}G_{ds}T_{ds}T_{ds}A_{ds}G_{ds}^mC_{ds}T_{ds}T_{ks}T_{es}A_{ks}A_{es}T_k$ | 47 | 1286 |
| 1341313 | 1778 | 1793 | 21593 | 21608 | TATGTAATAGCCAGTA | $T_{ks}A_{ks}T_{ds}G_{ds}T_{ds}A_{ds}A_{ds}T_{ds}A_{ds}G_{ds}^mC_{ds}^mC_{ks}A_{es}G_{ks}T_{es}A_k$ | 78 | 508 |
| 1341315 | 1782 | 1797 | 21597 | 21612 | TTCTTATGTAATAGCC | $T_{ks}T_{ks}^mC_{ds}T_{ds}T_{ds}A_{ds}T_{ds}G_{ds}T_{ds}A_{ds}A_{ds}T_{ks}A_{es}G_{ks}^mC_{es}^mC_k$ | 78 | 819 |
| 1341325 | 2247 | 2262 | 22062 | 22077 | ATAGTCCATGCAAAAG | $A_{ks}T_{ks}A_{ds}G_{ds}T_{ds}^mC_{ds}^mC_{ds}A_{ds}T_{ds}G_{ds}^mC_{ds}A_{ks}A_{es}A_{ks}A_{es}G_k$ | 31 | 2436 |
| 1341328 | 2193 | 2208 | 22008 | 22023 | TAGTCTTGATGTAGTG | $T_{ks}A_{ks}G_{ds}T_{ds}^mC_{ds}T_{ds}T_{ds}G_{ds}A_{ds}T_{ds}G_{ds}T_{ks}A_{es}G_{ks}T_{es}G_k$ | 43 | 1288 |
| 1341339 | N/A | N/A | 9330 | 9345 | CCTATATACATCCAAG | $^mC_{ks}^mC_{ks}T_{ds}A_{ds}T_{ds}A_{ds}T_{ds}A_{ds}^mC_{ds}A_{ds}T_{ds}^mC_{ks}^mC_{es}A_{ks}A_{es}G_k$ | 61 | 1771 |
| 1341343 | N/A | N/A | 11571 | 11586 | TCTTGACAATGGTTGA | $T_{ks}^mC_{ds}T_{ds}T_{ds}G_{ds}A_{ds}^mC_{ds}A_{ds}A_{ds}T_{ds}G_{ds}G_{ks}T_{es}T_{ks}G_{es}A_k$ | 40 | 2440 |
| 1341344 | N/A | N/A | 11855 | 11870 | TAAGCAGAATTGTGAA | $T_{ks}A_{ks}A_{ds}G_{ds}^mC_{ds}A_{ds}G_{ds}A_{ds}A_{ds}T_{ds}T_{ds}G_{ks}T_{es}G_{ks}A_{es}A_k$ | 29 | 2361 |
| 1341347 | N/A | N/A | 9964 | 9979 | GTGTAAGCTGAGAGTT | $G_{ks}T_{ks}G_{ds}T_{ds}A_{ds}A_{ds}G_{ds}^mC_{ds}T_{ds}G_{ds}A_{ds}G_{ks}A_{es}G_{ks}T_{es}T_k$ | 57 | 2760 |
| 1341351 | N/A | N/A | 12423 | 12438 | GGTGGTAACGGTGATC | $G_{ks}G_{ks}T_{ds}G_{ds}G_{ds}T_{ds}A_{ds}A_{ds}^mC_{ds}G_{ds}G_{ds}T_{ks}G_{es}A_{ks}T_{es}^mC_k$ | 39 | 2591 |
| 1341354 | N/A | N/A | 14914 | 14929 | ACATTAGCAAGCTAAG | $A_{ks}^mC_{ks}A_{ds}T_{ds}T_{ds}A_{ds}G_{ds}^mC_{ds}A_{ds}A_{ds}G_{ds}^mC_{ks}T_{ks}A_{es}A_{es}G_k$ | 23 | 2065 |
| 1341360 | N/A | N/A | 15494 | 15509 | GCATTAATGCCACCCT | $G_{ks}^mC_{ks}A_{ds}T_{ds}T_{ds}A_{ds}A_{ds}T_{ds}G_{ds}^mC_{ds}^mC_{ds}A_{ks}^mC_{es}^mC_{ks}^mC_{es}T_k$ | 24 | 1012 |
| 1341361 | N/A | N/A | 16287 | 16302 | TAGAATAGTCTTCAGC | $T_{ks}A_{ks}G_{ds}A_{ds}A_{ds}T_{ds}A_{ds}G_{ds}T_{ds}^mC_{ds}T_{ds}T_{ks}^mC_{es}A_{ks}G_{es}^mC_k$ | 50 | 1403 |
| 1341375 | N/A | N/A | 17992 | 18007 | AGTTAGTATAGTTATC | $A_{ks}G_{ds}T_{ds}T_{ds}A_{ds}G_{ds}T_{ds}A_{ds}T_{ds}A_{ds}G_{ds}T_{ks}T_{es}A_{ks}T_{es}^mC_k$ | 47 | 1249 |

TABLE 39-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % Inhibition | SEQ ID NO |
|---|---|---|---|---|---|---|---|---|
| 1341377 | N/A | N/A | 16380 | 16395 | CCAACCAAACTTCCAG | $^mC_{ks}{}^mC_{ks}A_{ds}A_{ds}{}^mC_{ds}{}^mC_{ds}A_{ds}A_{ds}A_{ds}{}^mC_{ds}T_{ds}T_{ks}{}^mC_{es}{}^mC_{ks}A_{es}G_k$ | 15 | 2539 |
| 1341382 | N/A | N/A | 19908 | 19923 | TCTTAAGATACCCAGG | $T_{ks}{}^mC_{ks}T_{ds}T_{ds}A_{ds}A_{ds}G_{ds}A_{ds}T_{ds}A_{ds}{}^mC_{ds}{}^mC_{ks}{}^mC_{es}A_{ks}G_{es}G_k$ | 35 | 319 |
| 1341387 | N/A | N/A | 18693 | 18708 | AGACTTTGAGACTCTT | $A_{ks}G_{ks}A_{ds}{}^mC_{ds}T_{ds}T_{ds}T_{ds}G_{ds}A_{ds}G_{ds}A_{ds}{}^mC_{ks}T_{es}{}^mC_{ks}T_{es}T_k$ | 55 | 2804 |
| 1341389 | N/A | N/A | 19912 | 19927 | TGCATCTTAAGATACC | $T_{ks}G_{ks}{}^mC_{ds}A_{ds}T_{ds}{}^mC_{ds}T_{ds}T_{ds}A_{ds}A_{ds}G_{ds}A_{ks}T_{es}A_{ks}{}^mC_{es}{}^mC_k$ | 24 | 2050 |
| 1341393 | N/A | N/A | 20381 | 20396 | AATCACAAGTAAGGTA | $A_{ks}A_{ks}T_{ds}{}^mC_{ds}A_{ds}{}^mC_{ds}A_{ds}A_{ds}G_{ds}T_{ds}A_{ds}A_{ks}G_{es}G_{ks}T_{es}A_k$ | 59 | 1333 |
| 1341396 | N/A | N/A | 20116 | 20131 | CAGCATCAAGACATTC | $^mC_{ks}A_{ks}G_{ds}{}^mC_{ds}A_{ds}T_{ds}{}^mC_{ds}A_{ds}A_{ds}G_{ds}A_{ds}{}^mC_{ks}A_{es}T_{ks}T_{es}{}^mC_k$ | 62 | 2191 |
| 1341406 | N/A | N/A | 12503 | 12518 | TTGCAGAAATTCACCT | $T_{ks}T_{ks}G_{ds}{}^mC_{ds}A_{ds}G_{ds}A_{ds}A_{ds}A_{ds}T_{ds}T_{ds}{}^mC_{ks}A_{es}{}^mC_{ks}{}^mC_{es}T_k$ | 46 | 2528 |
| 1341407 | N/A | N/A | 20482 | 20497 | TCATAGTGGACTTCAT | $T_{ks}{}^mC_{ks}A_{ds}T_{ds}A_{ds}G_{ds}T_{ds}G_{ds}G_{ds}A_{ds}{}^mC_{ds}T_{ks}T_{es}{}^mC_{ks}A_{es}T_k$ | 48 | 633 |
| 1341412 | N/A | N/A | 14196 | 14211 | TATGTGATTGAGTTCT | $T_{ks}A_{ks}T_{ds}G_{ds}T_{ds}G_{ds}A_{ds}T_{ds}T_{ds}G_{ds}A_{ds}G_{ks}T_{es}T_{ks}{}^mC_{es}T_k$ | 23 | 2367 |
| 1341415 | N/A | N/A | 13952 | 13967 | TCTAAGTTAGCCCCCA | $T_{ks}{}^mC_{ks}T_{ds}A_{ds}A_{ds}G_{ds}T_{ds}T_{ds}A_{ds}G_{ds}{}^mC_{ds}{}^mC_{ks}{}^mC_{es}{}^mC_{ks}{}^mC_{es}A_k$ | 19 | 928 |
| 1341417 | N/A | N/A | 14170 | 14185 | GAATAGCAAGCCAACA | $G_{ks}A_{ds}A_{ds}T_{ds}A_{ds}G_{ds}{}^mC_{ds}A_{ds}A_{ds}G_{ds}{}^mC_{ds}{}^mC_{ks}A_{es}A_{ks}{}^mC_{es}A_k$ | 27 | 1708 |
| 1341532 | 805 | 820 | 15686 | 15701 | GTAAGTATTCCATCTA | $G_{ks}T_{ks}A_{ds}A_{ds}G_{ds}T_{ds}A_{ds}T_{ds}T_{ds}{}^mC_{ds}{}^mC_{ds}A_{ks}T_{es}{}^mC_{ks}T_{es}A_k$ | 53 | 1038 |
| 1341534 | 613 | 628 | N/A | N/A | CTGGAACAATATGGGA | $^mC_{ks}T_{ks}G_{ds}G_{ds}A_{ds}A_{ds}{}^mC_{ds}A_{ds}A_{ds}T_{ds}A_{ds}T_{ks}G_{es}G_{ks}G_{es}A_k$ | 33 | 1969 |
| 1341538 | 1091 | 1106 | 20906 | 20921 | CGTTTGACTGCTGCTA | $^mC_{ks}G_{ks}T_{ds}T_{ds}T_{ds}G_{ds}A_{ds}{}^mC_{ds}T_{ds}G_{ds}{}^mC_{ds}T_{ks}G_{es}{}^mC_{ks}T_{es}A_k$ | 48 | 264 |
| 1341541 | 1320 | 1335 | 21135 | 21150 | CTTGAACAGTCTTAAA | $^mC_{ks}T_{ks}T_{ds}G_{ds}A_{ds}A_{ds}{}^mC_{ds}A_{ds}G_{ds}T_{ds}{}^mC_{ds}T_{ks}T_{es}A_{ks}A_{es}A_k$ | 38 | 500 |
| 1341543 | 1308 | 1323 | 21123 | 21138 | TAAACCTTCCCTGTGT | $T_{ks}A_{ks}A_{ds}A_{ds}{}^mC_{ds}{}^mC_{ds}T_{ds}T_{ds}{}^mC_{ds}{}^mC_{ds}{}^mC_{ds}T_{ks}G_{es}T_{ks}G_{es}T_k$ | 9 | 1745 |
| 1341547 | 1076 | 1091 | 20891 | 20906 | AGTGCCAAACCAATGT | $A_{ks}G_{ks}T_{ds}G_{ds}{}^mC_{ds}{}^mC_{ds}A_{ds}A_{ds}A_{ds}{}^mC_{ds}{}^mC_{ds}A_{ks}A_{es}T_{ks}G_{es}T_k$ | 71 | 1120 |
| 1341551 | 1347 | 1362 | 21162 | 21177 | GTGGCATGGCTACAGA | $G_{ks}T_{ks}G_{ds}G_{ds}{}^mC_{ds}A_{ds}T_{ds}G_{ds}G_{ds}{}^mC_{ds}T_{ds}A_{ks}{}^mC_{es}A_{ks}G_{es}A_k$ | 59 | 501 |
| 1341555 | 1328 | 1343 | 21143 | 21158 | GAATGCTACTTGAACA | $G_{ks}A_{ks}A_{ds}T_{ds}G_{ds}{}^mC_{ds}T_{ds}A_{ds}{}^mC_{ds}T_{ds}T_{ds}G_{ks}A_{es}A_{ks}{}^mC_{es}A_k$ | 48 | 1123 |
| 1341564 | 1425 | 1440 | 21240 | 21255 | GTCCAGGTTGAGATAA | $G_{ks}T_{ks}{}^mC_{ds}{}^mC_{ds}A_{ds}G_{ds}G_{ds}T_{ds}T_{ds}G_{ds}A_{ds}G_{ks}A_{es}T_{ks}A_{es}A_k$ | 36 | 113 |
| 1341565 | 1461 | 1476 | 21276 | 21291 | CTAGGGAAATCTTTCA | $^mC_{ks}T_{ks}A_{ds}G_{ds}G_{ds}G_{ds}A_{ds}A_{ds}A_{ds}T_{ds}{}^mC_{ds}T_{ks}T_{es}T_{ks}{}^mC_{es}A_k$ | 46 | 659 |
| 1341567 | 1415 | 1430 | 21230 | 21245 | AGATAAAGCTGCCTGC | $A_{ks}G_{ks}A_{ds}T_{ds}A_{ds}A_{ds}A_{ds}G_{ds}{}^mC_{ds}T_{ds}G_{ds}{}^mC_{ks}{}^mC_{es}T_{ks}G_{es}{}^mC_k$ | 30 | 1515 |
| 1341568 | 1718 | 1733 | 21533 | 21548 | GTCTAAACATCTCTGG | $G_{ks}T_{ks}{}^mC_{ds}T_{ds}A_{ds}A_{ds}A_{ds}{}^mC_{ds}A_{ds}T_{ds}{}^mC_{ds}T_{ks}{}^mC_{es}T_{ks}G_{es}G_k$ | 50 | 429 |
| 1341569 | 1504 | 1519 | 21319 | 21334 | AGAATAGAGTTGCACC | $A_{ks}G_{ks}A_{ds}A_{ds}T_{ds}A_{ds}G_{ds}A_{ds}G_{ds}T_{ds}T_{ds}G_{ks}{}^mC_{es}A_{ks}{}^mC_{es}{}^mC_k$ | 59 | 426 |

TABLE 39-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % Inhibition | SEQ ID NO |
|---|---|---|---|---|---|---|---|---|
| 1341575 | 1614 | 1629 | 21429 | 21444 | TCACCTTTCATAATGT | $T_{ks}{}^mC_{ks}A_{ds}{}^mC_{ds}{}^mC_{ds}T_{ds}T_{ds}T_{ds}$ $^mC_{ds}A_{ds}T_{ds}A_{ks}A_{es}T_{ks}G_{es}T_k$ | 31 | 2109 |
| 1341578 | 2186 | 2201 | 22001 | 22016 | GATGTAGTGGGAGTCG | $G_{ks}A_{ks}T_{ds}G_{ds}T_{ds}A_{ds}G_{ds}T_{ds}G_{ds}$ $G_{ds}G_{ds}A_{ds}G_{es}T_{ks}{}^mC_{es}G_k$ | 38 | 743 |
| 1341580 | 2257 | 2272 | 22072 | 22087 | AAACAAGAGGATAGTC | $A_{ks}A_{ks}A_{ds}{}^mC_{ds}A_{ds}A_{ds}G_{ds}A_{ds}$ $G_{ds}G_{ds}A_{ds}T_{ks}A_{es}G_{ks}T_{es}{}^mC_k$ | 52 | 744 |
| 1341585 | 1774 | 1789 | 21589 | 21604 | TAATAGCCAGTACAGT | $T_{ks}A_{ks}A_{ds}T_{ds}A_{ds}G_{ds}{}^mC_{ds}{}^mC_{ds}$ $A_{ds}G_{ds}T_{ds}A_{ks}{}^mC_{es}A_{ks}G_{es}T_k$ | 44 | 196 |
| 1341588 | N/A | N/A | 9511 | 9526 | AATATTGAGGCACTGG | $A_{ks}A_{ks}T_{ds}A_{ds}T_{ds}T_{ds}G_{ds}A_{ds}G_{ds}$ $G_{ds}{}^mC_{ds}A_{ks}{}^mC_{es}T_{ks}G_{es}G_k$ | 29 | 1538 |
| 1341596 | N/A | N/A | 9598 | 9613 | ATGTGAAGAGCTGGTA | $A_{ks}T_{ks}G_{ds}T_{ds}G_{ds}A_{ds}A_{ds}G_{ds}A_{ds}$ $G_{ds}{}^mC_{ds}T_{ks}G_{es}G_{ks}T_{es}A_k$ | 54 | 527 |
| 1341603 | N/A | N/A | 16134 | 16149 | GATGCTCCATAATAAT | $G_{ks}A_{ks}T_{ds}G_{ds}{}^mC_{ds}T_{ds}{}^mC_{ds}{}^mC_{ds}$ $A_{ds}T_{ds}A_{ds}A_{ks}T_{es}A_{ks}A_{es}T_k$ | 17 | 2049 |
| 1341604 | N/A | N/A | 16124 | 16139 | AATAATAGCTCTATTG | $A_{ks}A_{ks}T_{ds}A_{ds}A_{ds}T_{ds}A_{ds}G_{ds}{}^m$ $C_{ds}T_{ds}{}^mC_{ds}T_{ks}A_{es}T_{ks}T_{es}G_k$ | 2 | 2410 |
| 1341614 | N/A | N/A | 17987 | 18002 | GTATAGTTATCTTCTC | $G_{ks}T_{ks}A_{ds}T_{ds}A_{ds}G_{ds}T_{ds}T_{ds}A_{ds}$ $T_{ds}{}^mC_{ds}T_{ks}T_{es}{}^mC_{ks}T_{es}{}^mC_k$ | 49 | 937 |
| 1341615 | N/A | N/A | 17997 | 18012 | TATGAAGTTAGTATAG | $T_{ks}A_{ks}T_{ds}G_{ds}A_{ds}A_{ds}G_{ds}T_{ds}T_{ds}$ $A_{ds}G_{ds}T_{ks}A_{es}T_{ks}A_{es}G_k$ | 47 | 1560 |

TABLE 40

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ds}A_{ds}G_{ds}A_{ds}T_{ds}G_{ds}G_{ds}$ $T_{ds}A_{ds}G_{ds}T_{ks}{}^mC_{ks}A_k$ | 76 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}$ $A_{ds}T_{ds}T_{ds}{}^mC_{ds}A_{ks}G_{ks}T_k$ | 84 | 1526 |
| 1341176 | 796 | 811 | 15677 | 15692 | CCATCTATCAGACTTC | $^mC_{ks}{}^mC_{ks}A_{ds}T_{ds}{}^mC_{ds}T_{ds}A_{ds}T_{ds}$ $^mC_{ds}A_{ds}G_{ds}A_{ks}{}^mC_{es}T_{ks}T_{es}{}^mC_k$ | 52 | 415 |
| 1341182 | 808 | 823 | 15689 | 15704 | TTGGTAAGTATTCCAT | $T_{ks}T_{ks}G_{ds}G_{ds}T_{ds}A_{ds}A_{ds}G_{ds}T_{ds}$ $A_{ds}T_{ds}T_{ks}{}^mC_{es}{}^mC_{ks}A_{es}T_k$ | 13 | 2750 |
| 1341183 | 1077 | 1092 | 20892 | 20907 | TAGTGCCAAACCAATG | $T_{ks}A_{ks}G_{ds}T_{ds}G_{ds}{}^mC_{ds}{}^mC_{ds}A_{ds}$ $A_{ds}A_{ds}{}^mC_{ds}{}^mC_{ks}A_{es}A_{ks}T_{es}G_k$ | 66 | 1198 |
| 1341187 | 1081 | 1096 | 20896 | 20911 | CTGCTAGTGCCAAACC | $^mC_{ks}T_{ks}G_{ds}{}^mC_{ds}T_{ds}A_{ds}G_{ds}T_{ds}G_{ds}$ $^mC_kCA_{s}{}^mCA_{s}A_{ks}A_{es}A_{ks}{}^mC_{es}{}^mC_k$ | 51 | 1510 |
| 1341191 | 1085 | 1100 | 20900 | 20915 | ACTGCTGCTAGTGCCA | $A_{ks}{}^mC_{ks}T_{ds}G_{ds}{}^mC_{ds}T_{ds}G_{ds}{}^mC_{ds}$ $T_{ds}A_{ds}G_{ds}T_{ks}G_{es}{}^mC_{ks}{}^mC_{es}A_k$ | 39 | 1821 |
| 1341202 | 1259 | 1274 | 21074 | 21089 | GTAGCTTTTGTCCACC | $G_{ks}T_{ks}A_{ds}G_{ds}{}^mC_{ds}T_{ds}T_{ds}T_{ds}T_{ds}$ $G_{ds}T_{ds}{}^mC_{ks}{}^mC_{es}A_{ks}{}^mC_{es}{}^mC_k$ | 34 | 1978 |
| 1341204 | 1313 | 1328 | 21128 | 21143 | AGTCTTAAACCTTCCC | $A_{ks}G_{ks}T_{ds}{}^mC_{ds}T_{ds}T_{ds}A_{ds}A_{ds}A_{ds}$ $^mC_{ds}{}^mC_{ds}T_{ks}T_{es}{}^mC_{ks}{}^mC_{es}{}^mC_k$ | 43 | 1979 |
| 1341211 | 1325 | 1340 | 21140 | 21155 | TGCTACTTGAACAGTC | $T_{ks}G_{ks}{}^mC_{ds}T_{ds}A_{ds}{}^mC_{ds}T_{ds}T_{ds}G_{ds}$ $A_{ds}A_{ds}{}^mC_{ks}A_{es}G_{ks}T_{es}{}^mC_k$ | 64 | 889 |

TABLE 40 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341214 | 1321 | 1336 | 21136 | 21151 | ACTTGAACAGTCTTAA | $A_{ks}{}^mC_{ks}T_{ds}G_{ds}A_{ds}A_{ds}{}^mC_{ds}A_{ds}G_{ds}T_{ds}{}^mC_{ks}T_{es}T_{ks}A_{es}A_k$ | 60 | 578 |
| 1341218 | 1317 | 1332 | 21132 | 21147 | GAACAGTCTTAAACCT | $G_{ks}A_{ks}A_{ds}{}^mC_{ds}A_{ds}G_{ds}T_{ds}{}^mC_{ds}T_{ds}T_{ds}A_{ks}A_{es}{}^mC_{ks}{}^mC_{es}T_k$ | 63 | 266 |
| 1341222 | 1342 | 1357 | 21157 | 21172 | ATGGCTACAGATTGGA | $A_{ks}T_{ks}G_{ds}G_{ds}{}^mC_{ds}T_{ds}A_{ds}{}^mC_{ds}A_{ds}G_{ds}A_{ds}T_{ks}T_{es}G_{ks}G_{es}A_k$ | 57 | 111 |
| 1341226 | 1329 | 1344 | 21144 | 21159 | GGAATGCTACTTGAAC | $G_{ks}G_{ks}A_{ds}A_{ds}T_{ds}G_{ds}{}^mC_{ds}T_{ds}A_{ds}{}^mC_{ds}T_{ds}T_{ks}G_{es}A_{ks}A_{es}{}^mC_k$ | 49 | 1201 |
| 1341227 | 1335 | 1350 | 21150 | 21165 | CAGATTGGAATGCTAC | ${}^mC_{ks}A_{ks}G_{ds}A_{ds}T_{ds}T_{ds}G_{ds}G_{ds}A_{ds}A_{ds}T_{ds}G_{ks}{}^mC_{es}T_{ks}A_{es}{}^mC_k$ | 57 | 1590 |
| 1341237 | 1353 | 1368 | 21168 | 21183 | TATTCTGTGGCATGGC | $T_{ks}A_{ks}T_{ds}T_{ds}{}^mC_{ds}T_{ds}G_{ds}T_{ds}G_{ds}G_{ds}{}^mC_{ds}A_{ks}T_{es}G_{ks}G_{es}{}^mC_k$ | 57 | 890 |
| 1341242 | 1366 | 1381 | 21181 | 21196 | GTGTTCTTGTTGATAT | $G_{ks}T_{ks}G_{ds}T_{ds}T_{ds}{}^mC_{ds}T_{ds}T_{ds}G_{ds}T_{ds}T_{ds}CT_{ks}A_{es}T_{ks}A_eT_k$ | 63 | 1514 |
| 1341248 | 1357 | 1372 | 21172 | 21187 | TTGATATTCTGTGGCA | $T_{ks}T_{ks}G_{ds}A_{ds}T_{ds}A_{ds}T_{ds}T_{ds}{}^MC_{ds}T_{ds}G_{ds}T_{ks}G_{es}G_{ks}{}^mC_{es}A_k$ | 55 | 1202 |
| 1341254 | 1421 | 1436 | 21236 | 21251 | AGGTTGAGATAAAGCT | $A_{ks}G_{ks}G_{ds}T_{ds}T_{ds}G_{ds}A_{ds}G_{ds}A_{ds}T_{ds}A_{ds}A_{ks}A_{es}G_{ks}{}^mC_{es}T_k$ | 60 | 1904 |
| 1341262 | 1490 | 1505 | 21305 | 21320 | CCGTTTTGGGCTAATG | ${}^mC_{ks}{}^mC_{ks}G_{ds}T_{ds}T_{ds}T_{ds}T_{ds}G_{ds}G_{ds}G_{ds}{}^mC_{ds}T_{ks}A_{es}A_{ks}T_{es}G_k$ | 72 | 1360 |
| 1341265 | 1494 | 1509 | 21309 | 21324 | TGCACCGTTTTGGGCT | $T_{ks}G_{ks}{}^mC_{ds}A_{ds}{}^mC_{ds}{}^mC_{ds}G_{ds}T_{ds}T_{ds}T_{ds}T_{ds}G_{ks}G_{es}G_{ks}{}^mC_{es}T_k$ | 29 | 1671 |
| 1341269 | 1464 | 1479 | 21279 | 21294 | AGGCTAGGGAAATCTT | $A_{ks}G_{ks}G_{ds}{}^mC_{ds}T_{ds}A_{ds}G_{ds}G_{ds}G_{ds}A_{ds}A_{ds}A_{ks}T_{es}{}^mC_{ks}T_{es}T_k$ | 45 | 892 |
| 1341275 | 1619 | 1634 | 21434 | 21449 | GTCGGTCACCTTTCAT | $G_{ks}T_{ks}{}^mC_{ds}G_{ds}G_{ds}T_{ds}{}^mC_{ds}A_{ds}{}^mC_{ds}{}^mC_{ds}T_{ds}T_{ks}T_{es}{}^mC_{ks}A_{es}T_k$ | 57 | 194 |
| 1341277 | 1598 | 1613 | 21413 | 21428 | ATCTTATAAGACTATA | $A_{ks}T_{ks}{}^mC_{ds}T_{ds}T_{ds}A_{ds}T_{ds}A_{ds}A_{ds}G_{ds}A_{ds}{}^mC_{ks}T_{es}A_{ks}T_{es}A_k$ | 30 | 2661 |
| 1341284 | 1627 | 1642 | 21442 | 21457 | AAAATAGAGTCGGTCA | $A_{ks}A_{ks}A_{ds}A_{ds}T_{ds}A_{ds}G_{ds}A_{ds}G_{ds}T_{ds}{}^mC_{ds}G_{ks}G_{es}T_{ks}{}^mC_{es}A_k$ | 53 | 817 |
| 1341286 | 1623 | 1638 | 21438 | 21453 | TAGAGTCGGTCACCTT | $T_{ks}A_{ks}G_{ds}A_{ds}G_{ds}T_{ds}{}^mC_{ds}G_{ds}G_{ds}T_{ds}{}^mC_{ds}A_{ks}{}^mC_{es}{}^mC_{ks}T_{es}T_k$ | 48 | 506 |
| 1341291 | 1711 | 1726 | 21526 | 21541 | CATCTCTGGGACCAAG | ${}^mC_{ks}A_{ks}T_{ds}{}^mC_{ds}T_{ds}{}^mC_{ds}T_{ds}G_{ds}G_{ds}G_{ds}A_{ds}{}^mC_{ks}{}^mC_{es}A_{ks}A_{es}G_k$ | 44 | 117 |
| 1341292 | 1715 | 1730 | 21530 | 21545 | TAAACATCTCTGGGAC | $T_{ks}A_{ks}A_{ds}A_{ds}{}^mC_{ds}A_{ds}T_{ds}{}^mC_{ds}T_{ds}{}^mC_{ds}T_{ds}G_{ks}G_{es}G_{ks}A_{es}{}^mC_k$ | 39 | 351 |
| 1341300 | 1719 | 1734 | 21534 | 21549 | TGTCTAAACATCTCTG | $T_{ks}G_{ks}T_{ds}{}^mC_{ds}T_{ds}A_{ds}A_{ds}A_{ds}{}^mC_{ds}A_{ds}T_{ds}{}^mC_{ks}T_{es}{}^mC_{ks}T_{es}G_k$ | 59 | 507 |
| 1341302 | 1770 | 1785 | 21585 | 21600 | AGCCAGTACAGTTCCT | $A_{ks}G_{ks}{}^mC_{ds}{}^mC_{ds}A_{ds}G_{ds}T_{ds}A_{ds}{}^mC_{ds}A_{ds}G_{ds}T_{ks}T_{es}{}^mC_{ks}{}^mC_{es}T_k$ | 49 | 1909 |
| 1341307 | 1751 | 1766 | 21566 | 21581 | CCTGTGTTAGCTTTAA | ${}^mC_{ks}{}^mC_{ks}T_{ds}G_{ds}T_{ds}G_{ds}T_{ds}T_{ds}A_{ds}G_{ds}{}^mC_{ds}T_{ks}T_{es}T_{ks}A_{es}A_k$ | 62 | 1364 |
| 1341310 | 1783 | 1798 | 21598 | 21613 | TTTCTTATGTAATAGC | $T_{ks}T_{ks}T_{ds}{}^mC_{ds}T_{ds}T_{ds}A_{ds}T_{ds}G_{ds}T_{ds}A_{ds}A_{ks}T_{es}A_{ks}G_{es}{}^mC_k$ | 60 | 2128 |
| 1341314 | 1779 | 1794 | 21594 | 21609 | TTATGTAATAGCCAGT | $T_{ks}T_{ks}A_{ds}T_{ds}G_{ds}T_{ds}A_{ds}A_{ds}T_{ds}A_{ds}G_{ds}{}^mC_{ks}{}^mC_{es}A_{ks}G_{es}T_k$ | 63 | 586 |
| 1341316 | 1775 | 1790 | 21590 | 21605 | GTAATAGCCAGTACAG | $G_{ks}T_{ks}A_{ds}A_{ds}T_{ds}A_{ds}G_{ds}{}^mC_{ds}{}^mC_{ds}A_{ds}G_{ds}T_{ks}A_{es}{}^mC_{ks}A_{es}G_k$ | 47 | 274 |

TABLE 40 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341329 | 2187 | 2202 | 22002 | 22017 | TGATGTAGTGGGAGTC | $T_{ks}G_{ks}A_{ds}T_{ds}G_{ds}T_{ds}A_{ds}G_{ds}T_{ds}G_{ds}G_{ds}G_{ks}A_{es}G_{ks}T_{es}{}^{m}C_{k}$ | 46 | 820 |
| 1341332 | N/A | N/A | 9514 | 9529 | ACTAATATTGAGGCAC | $A_{ks}{}^{m}C_{ks}T_{ds}A_{ds}A_{ds}T_{ds}A_{ds}T_{ds}T_{ds}G_{ds}A_{ds}G_{ks}G_{es}{}^{m}C_{ks}A_{es}{}^{m}C_{k}$ | 27 | 1772 |
| 1341334 | 2250 | 2265 | 22065 | 22080 | AGGATAGTCCATGCAA | $A_{ks}G_{ds}G_{ds}A_{ds}T_{ds}A_{ds}G_{ds}T_{ds}{}^{m}C_{ds}{}^{m}C_{ds}A_{ds}T_{ks}G_{es}{}^{m}C_{ks}A_{es}A_{k}$ | 46 | 2690 |
| 1341337 | N/A | N/A | 9332 | 9347 | ATCCTATATACATCCA | $A_{ks}T_{ks}{}^{m}C_{ds}{}^{m}C_{ds}T_{ds}A_{ds}T_{ds}A_{ds}T_{ds}A_{ds}{}^{m}C_{ds}A_{ks}T_{es}{}^{m}C_{ks}{}^{m}C_{es}A_{k}$ | 65 | 1927 |
| 1341342 | N/A | N/A | 9966 | 9981 | TAGTGTAAGCTGAGAG | $T_{ks}A_{ks}G_{ds}T_{ds}G_{ds}T_{ds}A_{ds}A_{ds}G_{ds}{}^{m}C_{ds}T_{ds}G_{es}A_{ks}G_{es}A_{k}$ | 68 | 1852 |
| 1341346 | N/A | N/A | 9601 | 9616 | CATATGTGAAGAGCTG | ${}^{m}C_{ks}A_{ks}T_{ds}A_{ds}T_{ds}G_{ds}T_{ds}G_{ds}A_{ds}A_{ds}G_{ds}A_{ks}G_{es}{}^{m}C_{ks}T_{es}G_{k}$ | 35 | 683 |
| 1341348 | N/A | N/A | 11548 11573 | 11563 11588 | TCTCTTGACAATGGTT | $T_{ks}{}^{m}C_{ks}T_{ds}{}^{m}C_{ds}T_{ds}T_{ds}G_{ds}A_{ds}{}^{m}C_{ds}A_{ds}A_{ds}T_{ks}G_{es}G_{ks}T_{es}T_{k}$ | 70 100 | 1389 |
| 1341350 | N/A | N/A | 14916 | 14931 | ATACATTAGCAAGCTA | $A_{ks}T_{ks}A_{ds}{}^{m}C_{ds}A_{ds}T_{ds}T_{ds}A_{ds}G_{ds}{}^{m}C_{ds}A_{ds}A_{ks}G_{es}{}^{m}C_{ks}T_{es}A_{k}$ | 22 | 309 |
| 1341358 | N/A | N/A | 14197 | 14212 | TTATGTGATTGAGTTC | $T_{ks}T_{ks}A_{ds}T_{ds}G_{ds}T_{ds}G_{ds}A_{ds}T_{ds}T_{ds}G_{ds}A_{ks}G_{es}T_{ks}T_{es}{}^{m}C_{k}$ | 21 | 2431 |
| 1341363 | N/A | N/A | 15496 | 15511 | CTGCATTAATGCCACC | ${}^{m}C_{ks}T_{ks}G_{ds}{}^{m}C_{ds}A_{ds}T_{ds}T_{ds}A_{ds}A_{ds}T_{ds}G_{ds}{}^{m}C_{ks}{}^{m}C_{es}A_{ks}{}^{m}C_{es}{}^{m}C_{k}$ | 6 | 1168 |
| 1341364 | N/A | N/A | 16127 | 16142 | CATAATAATAGCTCTA | ${}^{m}C_{ks}A_{ks}T_{ds}A_{ds}A_{ds}T_{ds}A_{ds}A_{ds}T_{ds}A_{ds}G_{ds}{}^{m}C_{ks}T_{es}{}^{m}C_{ks}{}^{m}C_{es}A_{k}$ | 13 | 2511 |
| 1341365 | N/A | N/A | 16289 | 16304 | GTTAGAATAGTCTTCA | $G_{ks}T_{ks}T_{ds}A_{ds}G_{ds}A_{ds}A_{ds}T_{ds}A_{ds}G_{ds}T_{ds}{}^{m}C_{ks}T_{es}T_{ks}{}^{m}C_{es}A_{k}$ | 45 | 1481 |
| 1341370 | N/A | N/A | 16382 | 16397 | TCCCAACCAAACTTCC | $T_{ks}{}^{m}C_{ks}{}^{m}C_{ds}{}^{m}C_{ds}A_{ds}A_{ds}{}^{m}C_{ds}{}^{m}C_{ds}A_{ds}A_{ds}A_{ds}{}^{m}C_{ks}T_{es}T_{ks}{}^{m}C_{es}{}^{m}C_{k}$ | 27 | 2026 |
| 1341371 | N/A | N/A | 18095 | 18110 | AATTGATACACCAATG | $A_{ks}A_{ks}T_{ds}T_{ds}G_{ds}A_{ds}T_{ds}A_{ds}{}^{m}C_{ds}A_{ds}{}^{m}C_{ds}{}^{m}C_{ks}A_{es}A_{ks}T_{es}G_{k}$ | 50 | 2525 |
| 1341376 | N/A | N/A | 17994 | 18009 | GAAGTTAGTATAGTTA | $G_{ks}A_{ks}A_{ds}G_{ds}T_{ds}T_{ds}A_{ds}G_{ds}T_{ds}A_{ds}T_{ds}A_{ks}G_{es}T_{ks}T_{es}A_{k}$ | 56 | 1327 |
| 1341379 | N/A | N/A | 17989 | 18004 | TAGTATAGTTATCTTC | $T_{ks}A_{ks}G_{ds}T_{ds}A_{ds}T_{ds}A_{ds}G_{ds}T_{ds}T_{ds}A_{ds}T_{ks}{}^{m}C_{es}T_{ks}T_{es}{}^{m}C_{k}$ | 34 | 1093 |
| 1341380 | N/A | N/A | 19909 | 19924 | ATCTTAAGATACCCAG | $A_{ks}T_{ks}{}^{m}C_{ds}T_{ds}T_{ds}A_{ds}A_{ds}G_{ds}A_{ds}T_{ds}A_{ds}{}^{m}C_{ks}{}^{m}C_{es}{}^{m}C_{ks}A_{es}G_{k}$ | 45 | 397 |
| 1341384 | N/A | N/A | 19913 | 19928 | GTGCATCTTAAGATAC | $G_{ks}T_{ks}G_{ds}{}^{m}C_{ds}A_{ds}T_{ds}{}^{m}C_{ds}T_{ds}T_{ds}A_{ds}A_{ds}G_{ks}A_{es}T_{ks}A_{es}{}^{m}C_{k}$ | 20 | 2806 |
| 1341388 | N/A | N/A | 18695 | 18710 | AAAGACTTTGAGACTC | $A_{ks}A_{ks}A_{ds}G_{ds}A_{ds}{}^{m}C_{ds}T_{ds}T_{ds}T_{ds}G_{ds}A_{ds}G_{ks}A_{es}{}^{m}C_{ks}T_{es}{}^{m}C_{k}$ | 45 | 1250 |
| 1341391 | N/A | N/A | 20383 | 20398 | GTAATCACAAGTAAGG | $G_{ks}T_{ks}A_{ds}A_{ds}T_{ds}{}^{m}C_{ds}A_{ds}{}^{m}C_{ds}A_{ds}A_{ds}G_{ds}T_{ks}A_{es}A_{ks}G_{es}G_{k}$ | 72 | 1411 |
| 1341399 | N/A | N/A | 20190 | 20205 | AGTTATTAGAAGTCAG | $A_{ks}G_{ks}T_{ds}T_{ds}A_{ds}T_{ds}T_{ds}A_{ds}G_{ds}A_{ds}A_{ds}G_{ks}T_{es}{}^{m}C_{ks}A_{es}G_{k}$ | 42 | 2746 |
| 1341401 | N/A | N/A | 20484 | 20499 | CTTCATAGTGGACTTC | ${}^{m}C_{ks}T_{ks}T_{ds}{}^{m}C_{ds}A_{ds}T_{ds}A_{ds}G_{ds}T_{ds}G_{ds}G_{ds}A_{ks}{}^{m}C_{es}T_{ks}T_{es}{}^{m}C_{k}$ | 45 | 711 |
| 1341410 | N/A | N/A | 13954 | 13969 | CCTCTAAGTTAGCCCC | ${}^{m}C_{ks}{}^{m}C_{ks}T_{ds}{}^{m}C_{ds}T_{ds}A_{ds}A_{ds}G_{ds}T_{ds}T_{ds}A_{ds}G_{ks}{}^{m}C_{es}{}^{m}C_{ks}{}^{m}C_{es}{}^{m}C_{k}$ | 20 | 1084 |
| 1341418 | N/A | N/A | 12797 | 12812 | TGTAAGAGTCAGTATC | $T_{ks}G_{ks}T_{ds}A_{ds}A_{ds}G_{ds}A_{ds}G_{ds}T_{ds}{}^{m}C_{ds}A_{ds}G_{ks}T_{es}A_{ks}T_{es}{}^{m}C_{k}$ | 35 | 2652 |

TABLE 40 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341419 | N/A | N/A | 14172 | 14187 | TTGAATAGCAAGCCAA | $T_{ks}T_{ks}G_{ds}A_{ds}A_{ds}T_{ds}A_{ds}G_{ds}{}^mC_{ds}A_{ds}A_{ds}G_{ks}{}^mC_{es}{}^mC_{es}A_{es}A_k$ | 27 | 1864 |
| 1341529 | 693 | 708 | 12111 | 12126 | ATGAGGTTTTGATACC | $A_{ks}T_{ks}G_{ds}A_{ds}G_{ds}G_{ds}T_{ds}T_{ds}T_{ds}T_{ds}G_{ds}A_{ks}T_{es}A_{ks}{}^mC_{es}{}^mC_k$ | 51 | 569 |
| 1341533 | 1022 | 1037 | 20837 | 20852 | CTTTGCAGCATTGATT | ${}^mC_{ks}T_{ks}T_{ds}T_{ds}G_{ds}{}^mC_{ds}A_{ds}G_{ds}{}^mC_{ds}A_{ds}T_{ds}T_{ks}G_{es}A_{ks}T_{es}T_k$ | 49 | 2463 |
| 1341540 | 1309 | 1324 | 21124 | 21139 | TTAAACCTTCCCTGTG | $T_{ks}T_{ks}A_{ds}A_{ds}A_{ds}{}^mC_{ds}{}^mC_{ds}T_{ds}T_{ds}{}^mC_{ds}{}^mC_{ds}{}^mC_{ks}T_{es}G_{ks}T_{es}G_k$ | 0 | 2807 |
| 1341545 | 1175 | 1190 | 20990 | 21005 | TAAGAGGCATGAAAGG | $T_{ks}A_{ks}A_{ds}G_{ds}A_{ds}G_{ds}G_{ds}{}^mC_{ds}A_{ds}T_{ds}G_{ks}A_{es}A_{ks}G_{es}G_k$ | 54 | 2751 |
| 1341546 | 1251 | 1266 | 21066 | 21081 | TGTCCACCTTTAAATG | $T_{ks}G_{ks}T_{ds}{}^mC_{ds}{}^mC_{ds}A_{ds}{}^mC_{ds}{}^mC_{ds}T_{ds}T_{ds}T_{ds}A_{ks}A_{es}A_{ks}T_{es}G_k$ | 27 | 1666 |
| 1341552 | 1348 | 1363 | 21163 | 21178 | TGTGGCATGGCTACAG | $T_{ks}G_{ks}T_{ds}G_{ds}G_{ds}{}^mC_{ds}A_{ds}T_{ds}G_{ds}G_{ds}{}^mC_{ds}T_{ks}A_{es}{}^mC_{ks}A_{es}G_k$ | 22 | 579 |
| 1341554 | 1394 | 1409 | 21209 | 21224 | CTTGATCTCTTAGCTG | ${}^mC_{ks}T_{ks}T_{ds}G_{ds}A_{ds}T_{ds}{}^mC_{ds}T_{ds}{}^mC_{ds}T_{ds}T_{ds}A_{ks}G_{es}{}^mC_{ks}T_{es}G_k$ | 49 | 736 |
| 1341558 | 1388 | 1403 | 21203 | 21218 | CTCTTAGCTGTGCACT | ${}^mC_{ks}T_{ks}{}^mC_{ds}T_{ds}T_{ds}A_{ds}G_{ds}{}^mC_{ds}T_{ds}G_{ds}T_{ds}G_{ks}{}^mC_{es}A_{ks}{}^mC_{es}T_k$ | 56 | 268 |
| 1341560 | 1498 | 1513 | 21313 | 21328 | GAGTTGCACCGTTTTG | $G_{ks}A_{ks}G_{ds}T_{ds}T_{ds}G_{ds}{}^mC_{ds}A_{ds}{}^mC_{ds}{}^mC_{ds}G_{ds}T_{ks}T_{es}T_{ks}T_{es}G_k$ | 61 | 1983 |
| 1341563 | 1416 | 1431 | 21231 | 21246 | GAGATAAAGCTGCCTG | $G_{ks}A_{ks}G_{ds}A_{ds}T_{ds}A_{ds}A_{ds}A_{ds}G_{ds}{}^mC_{ds}T_{ds}G_{ks}{}^mC_{es}{}^mC_{ks}T_{es}G_k$ | 40 | 1592 |
| 1341566 | 1426 | 1441 | 21241 | 21256 | TGTCCAGGTTGAGATA | $T_{ks}G_{ks}T_{ds}{}^mC_{ds}{}^mC_{ds}A_{ds}G_{ds}G_{ds}T_{ds}T_{ds}G_{ds}A_{ks}G_{es}A_{ks}T_{es}A_k$ | 48 | 191 |
| 1341574 | 1615 | 1630 | 21430 | 21445 | GTCACCTTTCATAATG | $G_{ks}T_{ks}{}^mC_{ds}A_{ds}{}^mC_{ds}{}^mC_{ds}T_{ds}T_{ds}T_{ds}{}^mC_{ds}A_{ds}T_{ks}A_{es}A_{ks}T_{es}G_k$ | 4 | 1907 |
| 1341577 | 1705 | 1720 | 21520 | 21535 | TGGGACCAAGGATATA | $T_{ks}G_{ks}G_{ds}G_{ds}A_{ds}{}^mC_{ds}{}^mC_{ds}A_{ds}A_{ds}G_{ds}G_{ds}A_{ks}T_{es}A_{ks}T_{es}A_k$ | 30 | 1674 |
| 1341583 | 2194 | 2209 | 22009 | 22024 | TTAGTCTTGATGTAGT | $T_{ks}T_{ks}A_{ds}G_{ds}T_{ds}{}^mC_{ds}T_{ds}T_{ds}G_{ds}A_{ds}T_{ds}G_{ks}T_{es}A_{ks}G_{es}T_k$ | 36 | 1366 |
| 1341589 | N/A | N/A | 11858 | 11873 | GATTAAGCAGAATTGT | $G_{ks}A_{ks}T_{ds}T_{ds}A_{ds}A_{ds}G_{ds}{}^mC_{ds}A_{ds}G_{ds}A_{ds}A_{ks}T_{es}T_{ks}G_{es}T_k$ | 31 | 1156 |
| 1341591 | N/A | N/A | 11543 | 11558 | TGACAATGGTTGCCAC | $T_{ks}G_{ks}A_{ds}{}^mC_{ds}A_{ds}A_{ds}T_{ds}G_{ds}G_{ds}T_{ds}T_{ds}G_{ks}{}^mC_{es}{}^mC_{ks}A_{es}{}^mC_k$ | 38 | 1233 |
| 1341595 | 2350 | 2365 | 22165 | 22180 | ACTACAAGAGGTTATT | $A_{ks}{}^mC_{ks}T_{ds}A_{ds}{}^mC_{ds}A_{ds}A_{ds}G_{ds}A_{ds}G_{ds}G_{ds}T_{ks}T_{es}A_{ks}T_{es}T_k$ | 42 | 899 |
| 1341600 | N/A | N/A | 12416 | 12431 | ACGGTGATCAAATGTA | $A_{ks}{}^mC_{ks}G_{ds}G_{ds}T_{ds}G_{ds}A_{ds}T_{ds}{}^mC_{ds}A_{ds}A_{ds}A_{ks}T_{es}G_{ks}T_{es}A_k$ | 33 | 2205 |
| 1341601 | N/A | N/A | 16218 | 16233 | TATAGACTGGGTAGGA | $T_{ks}A_{ks}T_{ds}A_{ds}G_{ds}A_{ds}{}^mC_{ds}T_{ds}G_{ds}G_{ds}G_{ds}T_{ks}A_{es}G_{ks}G_{es}A_k$ | 38 | 2808 |
| 1341607 | N/A | N/A | 12426 | 12441 | CAGGGTGGTAACGGTG | ${}^mC_{ks}A_{ks}G_{ds}G_{ds}G_{ds}T_{ds}G_{ds}G_{ds}T_{ds}A_{ds}A_{ds}{}^mC_{ks}G_{es}G_{ks}T_{es}G_k$ | 49 | 2729 |

TABLE 41

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ds}A_{ds}G_{ds}A_{ds}T_{ds}G_{ds}G_{ds}T_{ds}A_{ds}A_{ds}G_{ds}T_{ks}{}^mC_{ks}A_k$ | 93 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 88 | 1526 |
| 1341165 | 608 | 623 | N/A | N/A | ACAATATGGGATGAGG | $A_{ks}{}^mC_{ks}A_{ds}A_{ds}T_{ds}A_{ds}T_{ds}G_{ds}G_{ds}G_{ds}A_{ds}T_{ks}G_{es}A_{ks}G_{es}G_k$ | 51 | 1579 |
| 1341170 | 810 | 825 | 15691 | 15706 | TATTGGTAAGTATTCC | $T_{ks}A_{ks}T_{ds}T_{ds}G_{ds}G_{ds}T_{ds}A_{ds}A_{ds}G_{ds}T_{ds}A_{ks}T_{es}T_{ks}{}^mC_{es}{}^mC_k$ | 36 | 1272 |
| 1341174 | 798 | 813 | 15679 | 15694 | TTCCATCTATCAGACT | $T_{ks}T_{ks}{}^mC_{ds}{}^mC_{ds}A_{ds}T_{ds}{}^mC_{ds}T_{ds}A_{ds}T_{ds}{}^mC_{ds}A_{ks}G_{es}A_{ks}{}^mC_{es}T_k$ | 33 | 571 |
| 1341177 | 696 | 711 | 12114 | 12129 | GACATGAGGTTTTGAT | $G_{ks}A_{ks}{}^mC_{ds}A_{ds}T_{ds}G_{ds}A_{ds}G_{ds}G_{ds}T_{ds}T_{ds}T_{ks}T_{es}G_{ks}A_{es}T_k$ | 55 | 647 |
| 1341181 | 1078 | 1093 | 20893 | 20908 | CTAGTGCCAAACCAAT | ${}^mC_{ks}T_{ks}A_{ds}G_{ds}T_{ds}G_{ds}{}^mC_{ds}{}^mC_{ds}A_{ds}A_{ds}A_{ds}{}^mC_{ks}{}^mC_{es}A_{ks}A_{es}T_k$ | 47 | 1276 |
| 1341185 | 1082 | 1097 | 20897 | 20912 | GCTGCTAGTGCCAAAC | $G_{ks}{}^mC_{ks}T_{ds}G_{ds}{}^mC_{ds}T_{ds}A_{ds}G_{ds}T_{ds}G_{ds}{}^mC_{ds}{}^mC_{kS}A_{eS}A_{ks}A_{es}{}^mC_k$ | 62 | 1587 |
| 1341195 | 1180 | 1195 | 20995 | 21010 | GTTTTTAAGAGGCATG | $G_{ks}T_{ks}T_{ds}T_{ds}T_{ds}T_{ds}A_{ds}A_{ds}G_{ds}A_{ds}G_{ds}Gr_{ks}{}^mC_{es}A_{ks}T_{es}G_k$ | 79 | 1199 |
| 1341197 | 1086 | 1101 | 20901 | 20916 | GACTGCTGCTAGTGCC | $G_{ks}A_{ks}{}^mC_{ds}T_{ds}G_{ds}{}^mC_{ds}T_{ds}G_{ds}{}^mC_{ds}T_{ds}A_{ds}G_{ks}T_{es}G_{ks}{}^mC_{es}{}^mC_k$ | 35 | 1899 |
| 1341201 | 1314 | 1329 | 21129 | 21144 | CAGTCTTAAACCTTCC | ${}^mC_{ks}A_{ks}G_{ds}T_{ds}{}^mC_{ds}T_{ds}T_{ds}A_{ds}A_{ds}A_{ds}{}^mC_{ds}{}^mC_{ks}T_{es}T_{ks}{}^mC_{es}{}^mC_k$ | 51 | 30 |
| 1341206 | 1256 | 1271 | 21071 | 21086 | GCTTTTGTCCACCTTT | $G_{ks}{}^mC_{ks}T_{ds}T_{ds}T_{ds}T_{ds}G_{ds}T_{ds}{}^mC_{ds}{}^mC_{ds}A_{ds}{}^mC_{ks}{}^mC_{es}T_{ks}T_{es}T_k$ | 75 | 1744 |
| 1341207 | 1261 | 1276 | 21076 | 21091 | AGGTAGCTTTTGTCCA | $A_{ks}G_{ks}G_{ds}T_{ds}A_{ds}G_{ds}{}^mC_{ds}T_{ds}T_{ds}T_{ds}T_{ds}G_{ks}T_{es}{}^mC_{ks}{}^mC_{es}A_k$ | 26 | 109 |
| 1341210 | 1326 | 1341 | 21141 | 21156 | ATGCTACTTGAACAGT | $A_{ks}T_{ks}G_{ds}{}^mC_{ds}T_{ds}A_{ds}{}^mC_{ds}T_{ds}T_{ds}G_{ds}A_{ds}A_{ks}{}^mC_{es}A_{ks}G_{es}T_k$ | 54 | 967 |
| 1341212 | 1322 | 1337 | 21137 | 21152 | TACTTGAACAGTCTTA | $T_{ks}A_{ks}{}^mC_{ds}T_{ds}T_{ds}G_{ds}A_{ds}A_{ds}{}^mC_{ds}A_{ds}G_{ds}T_{ks}{}^mC_{es}T_{ks}T_{es}A_k$ | 60 | 656 |
| 1341219 | 1318 | 1333 | 21133 | 21148 | TGAACAGTCTTAAACC | $T_{ks}G_{ks}A_{ds}A_{ds}{}^mC_{ds}A_{ds}G_{ds}T_{ds}{}^mC_{ds}T_{ds}T_{ds}A_{ks}A_{es}A_{ks}{}^mC_{es}{}^mC_k$ | 34 | 344 |
| 1341225 | 1344 | 1359 | 21159 | 21174 | GCATGGCTACAGATTG | $G_{ks}{}^mC_{ks}A_{ds}T_{ds}G_{ds}G_{ds}{}^mC_{ds}T_{ds}A_{ds}{}^mC_{ds}A_{ds}G_{ks}A_{es}T_{ks}T_{es}G_k$ | 41 | 267 |
| 1341231 | 1354 | 1369 | 21169 | 21184 | ATATTCTGTGGCATGG | $A_{ks}T_{ks}A_{ds}T_{ds}T_{ds}{}^mC_{ds}T_{ds}G_{ds}T_{ds}G_{ds}G_{ds}{}^mC_{ks}A_{ts}T_{ks}G_{es}G_k$ | 43 | 968 |
| 1341233 | 1358 | 1373 | 21173 | 21188 | GTTGATATTCTGTGGC | $G_{ks}T_{ks}T_{ds}G_{ds}A_{ds}T_{ds}A_{ds}T_{ds}T_{ds}{}^mC_{ds}T_{ds}G_{ks}T_{es}G_{es}{}^mC_k$ | 69 | 1280 |
| 1341238 | 1349 | 1364 | 21164 | 21179 | CTGTGGCATGGCTACA | ${}^mC_{ks}T_{ks}G_{ds}T_{ds}G_{ds}G_{ds}{}^mC_{ds}A_{ds}T_{ds}G_{ds}G_{ds}{}^mC_{ks}T_{es}A_{ks}{}^mC_{es}A_k$ | 33 | 657 |
| 1341240 | 1395 | 1410 | 21210 | 21225 | ACTTGATCTCTTAGCT | $A_{ks}{}^mC_{ks}T_{ds}T_{ds}G_{ds}A_{ds}T_{ds}{}^mC_{ds}T_{ds}{}^mC_{ds}T_{ds}T_{ks}A_{es}G_{ks}{}^mC_{es}T_k$ | 62 | 813 |
| 1341243 | 1389 | 1404 | 21204 | 21219 | TCTCTTAGCTGTGCAC | $T_{ks}{}^mC_{ks}T_{ds}{}^mC_{ds}T_{ds}T_{ds}A_{ds}G_{ds}{}^mC_{ds}T_{ds}G_{ds}T_{ks}G_{es}{}^mC_{ks}A_{es}{}^mC_k$ | 36 | 346 |
| 1341246 | 1367 | 1382 | 21182 | 21197 | TGTGTTCTTGTTGATA | $T_{ks}G_{ks}T_{ds}G_{ds}T_{ds}T_{ds}{}^mC_{ds}T_{ds}T_{ds}G_{ds}T_{ds}T_{ks}G_{es}A_{ks}T_{es}A_k$ | 64 | 1591 |
| 1341251 | 1429 | 1444 | 21244 | 21259 | ATATGTCCAGGTTGAG | $A_{ks}T_{ks}A_{ds}T_{ds}G_{ds}T_{ds}{}^mC_{ds}{}^mC_{ds}A_{ds}G_{ds}G_{ds}T_{ks}T_{es}G_{ks}A_{es}G_k$ | 28 | 425 |

TABLE 41 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341257 | 1418 | 1433 | 21233 | 21248 | TTGAGATAAAGCTGCC | $T_{ks}T_{ks}G_{ds}A_{ds}G_{ds}A_{ds}T_{ds}A_{ds}A_{ds}A_{ds}G_{ds}{}^mC_{ks}T_{es}G_{ks}{}^mC_{es}{}^mC_k$ | 2 | 1670 |
| 1341259 | 1422 | 1437 | 21237 | 21252 | CAGGTTGAGATAAAGC | ${}^mC_{ks}A_{ks}G_{ds}G_{ds}T_{ds}T_{ds}G_{ds}A_{ds}G_{ds}A_{ds}T_{ds}A_{ks}A_{es}A_{ks}G_{es}{}^mC_k$ | 53 | 1982 |
| 1341260 | 1491 | 1506 | 21306 | 21321 | ACCGTTTTGGGCTAAT | $A_{ks}{}^mC_{ks}{}^mC_{ds}G_{ds}T_{ds}T_{ds}T_{ds}T_{ds}G_{ds}G_{ds}G_{ds}{}^mC_{ks}T_{es}A_{ks}A_{es}T_k$ | 76 | 1438 |
| 1341261 | 1495 | 1510 | 21310 | 21325 | TTGCACCGTTTTGGGC | $T_{ks}T_{ks}G_{ds}{}^mC_{ds}A_{ds}{}^mC_{ds}{}^mC_{ds}G_{ds}T_{ds}T_{ds}T_{ds}T_{ks}G_{es}G_{ks}G_{es}{}^mC_k$ | 26 | 1749 |
| 1341268 | 1466 | 1481 | 21281 | 21296 | AGAGGCTAGGGAAATC | $A_{ks}G_{ks}A_{ds}G_{ds}G_{ds}{}^mC_{ds}T_{ds}A_{ds}G_{ds}G_{ds}G_{ds}A_{ks}A_{es}A_{ks}T_{es}{}^mC_k$ | 59 | 1048 |
| 1341273 | 1499 | 1514 | 21314 | 21329 | AGAGTTGCACCGTTTT | $A_{ks}G_{ks}A_{ds}G_{ds}T_{ds}T_{ds}G_{ds}{}^mC_{ds}A_{ds}{}^mC_{ds}{}^mC_{ds}G_{ks}T_{es}T_{ks}T_{es}T_k$ | 80 | 34 |
| 1341279 | 1600 | 1615 | 21415 | 21430 | GTATCTTATAAGACTA | $G_{ks}T_{ks}A_{ds}T_{ds}{}^mC_{ds}T_{ds}T_{ds}A_{ds}T_{ds}A_{ds}A_{ds}G_{ks}A_{es}{}^mC_{ks}T_{es}A_k$ | 61 | 1595 |
| 1341285 | 1624 | 1639 | 21439 | 21454 | ATAGAGTCGGTCACCT | $A_{ks}T_{ks}A_{ds}G_{ds}A_{ds}G_{ds}T_{ds}{}^mC_{ds}G_{ds}G_{ds}T_{ds}{}^mC_{ks}A_{es}{}^mC_{ks}{}^mC_{es}T_k$ | 56 | 584 |
| 1341288 | 1620 | 1635 | 21435 | 21450 | AGTCGGTCACCTTTCA | $A_{ks}G_{ks}T_{ds}{}^mC_{ds}G_{ds}G_{ds}T_{ds}{}^mC_{ds}A_{ds}{}^mC_{ds}{}^mC_{ds}T_{ks}T_{es}T_{ks}{}^mC_{es}A_k$ | 55 | 272 |
| 1341298 | 1712 | 1727 | 21527 | 21542 | ACATCTCTGGGACCAA | $A_{ks}{}^mC_{ks}A_{ds}T_{ds}{}^mC_{ds}T_{ds}{}^mC_{ds}T_{ds}G_{ds}G_{ds}G_{ds}A_{ks}{}^mC_{es}{}^mC_{ks}A_{es}A_k$ | 67 | 195 |
| 1341299 | 1628 | 1643 | 21443 | 21458 | TAAAATAGAGTCGGTC | $T_{ks}A_{ks}A_{ds}A_{ds}A_{ds}T_{ds}A_{ds}G_{ds}A_{ds}G_{ds}T_{ds}{}^mC_{ks}G_{es}G_{ks}T_{es}{}^mC_k$ | 68 | 895 |
| 1341306 | 1721 | 1736 | 21536 | 21551 | ATTGTCTAAACATCTC | $A_{ks}T_{ks}T_{ds}G_{ds}T_{ds}{}^mC_{ds}T_{ds}A_{ds}A_{ds}A_{ds}{}^mC_{ds}A_{ks}T_{es}{}^mC_{ks}T_{es}{}^mC_k$ | 62 | 585 |
| 1341308 | 1752 | 1767 | 21567 | 21582 | TCCTGTGTTAGCTTTA | $T_{ks}{}^mC_{ks}{}^mC_{ds}T_{ds}G_{ds}T_{ds}G_{ds}T_{ds}T_{ds}A_{ds}G_{ds}{}^mC_{ks}T_{es}T_{ks}T_{es}A_k$ | 79 | 1442 |
| 1341312 | 1784 | 1799 | 21599 | 21614 | GTTTCTTATGTAATAG | $G_{ks}T_{ks}T_{ds}T_{ds}{}^mC_{ds}T_{ds}T_{ds}A_{ds}T_{ds}G_{ds}T_{ds}A_{ks}A_{es}T_{ks}A_{es}G_k$ | 21 | 897 |
| 1341317 | 1780 | 1795 | 21595 | 21610 | CTTATGTAATAGCCAG | ${}^mC_{ks}T_{ks}T_{ds}A_{ds}T_{ds}G_{ds}T_{ds}A_{ds}A_{ds}T_{ds}A_{ds}G_{ks}{}^mC_{es}{}^mC_{ks}A_{es}G_k$ | 61 | 664 |
| 1341320 | 2189 | 2204 | 22004 | 22019 | CTTGATGTAGTGGGAG | ${}^mC_{ks}T_{ks}T_{ds}G_{ds}A_{ds}T_{ds}G_{ds}T_{ds}A_{ds}G_{ds}T_{ds}G_{ks}G_{es}G_{ks}A_{es}G_k$ | 20 | 976 |
| 1341324 | 2252 | 2267 | 22067 | 22082 | AGAGGATAGTCCATGC | $A_{ks}G_{ks}A_{ds}G_{ds}G_{ds}A_{ds}T_{ds}A_{ds}G_{ds}T_{ds}{}^mC_{ds}{}^mC_{ks}A_{es}T_{ks}G_{es}{}^mC_k$ | 70 | 354 |
| 1341330 | N/A | N/A | 9334 | 9349 | CGATCCTATATACATC | ${}^mC_{ks}G_{ks}A_{ds}T_{ds}{}^mC_{ds}{}^mC_{ds}T_{ds}A_{ds}T_{ds}A_{ds}T_{ds}A_{ks}{}^mC_{es}A_{ks}T_{es}{}^mC_k$ | 29 | 2788 |
| 1341331 | N/A | N/A | 9516 | 9531 | ACACTAATATTGAGGC | $A_{ks}{}^mC_{ks}A_{ds}{}^mC_{ds}T_{ds}A_{ds}A_{ds}T_{ds}A_{ds}T_{ds}T_{ds}G_{ks}A_{es}G_{ks}G_{es}{}^mC_k$ | 55 | 1928 |
| 1341336 | 2353 | 2368 | 22168 | 22183 | ATAACTACAAGAGGTT | $A_{ks}T_{ks}A_{ds}A_{ds}{}^mC_{ds}T_{ds}A_{ds}{}^mC_{ds}A_{ds}A_{ds}G_{ds}A_{ks}G_{es}G_{ks}T_{es}T_k$ | 46 | 1133 |
| 1341340 | N/A | N/A | 11546 | 11561 | TCTTGACAATGGTTGC | $T_{ks}{}^mC_{ks}T_{ds}T_{ds}G_{ds}A_{ds}{}^mC_{ds}A_{ds}A_{ds}T_{ds}G_{ds}G_{ks}T_{es}T_{ks}G_{es}{}^mC_k$ | 37 | 2199 |
| 1341341 | N/A | N/A | 9968 | 9983 | AGTAGTGTAAGCTGAG | $A_{ks}G_{ks}T_{ds}A_{ds}G_{ds}T_{ds}G_{ds}T_{ds}A_{ds}A_{ds}G_{ds}{}^mC_{ks}T_{es}G_{ks}A_{es}G_k$ | 52 | 2155 |
| 1341349 | N/A | N/A | 9603 | 9618 | CACATATGTGAAGAGC | ${}^mC_{ks}A_{ks}{}^mC_{ds}A_{ds}T_{ds}A_{ds}T_{ds}G_{ds}T_{ds}G_{ds}A_{ks}A_{ks}G_{es}A_{ks}G_{es}{}^mC_k$ | 53 | 760 |
| 1341352 | N/A | N/A | 15498 | 15513 | TGCTGCATTAATGCCA | $T_{ks}G_{ks}{}^mC_{ds}T_{ds}G_{ds}{}^mC_{ds}A_{ds}T_{ds}T_{ds}A_{ds}A_{ds}T_{ks}G_{es}{}^mC_{ks}{}^mC_{es}A_k$ | 30 | 2485 |

TABLE 41 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341355 | N/A | N/A | 14918 | 14933 | TAATACATTAGCAAGC | $T_{ks}A_{ks}A_{ds}T_{ds}A_{ds}{}^mC_{ds}A_{ds}T_{ds}T_{ds}A_{ds}G_{ds}{}^mC_{ks}A_{es}A_{ks}G_{es}{}^mC_k$ | 34 | 2266 |
| 1341356 | N/A | N/A | 12419 | 12434 | GTAACGGTGATCAAAT | $G_{ks}T_{ks}A_{ds}A_{ds}{}^mC_{ds}G_{ds}G_{ds}T_{ds}G_{ds}A_{ds}T_{ds}{}^mC_{ks}A_{es}A_{ks}A_{es}T_k$ | 34 | 2345 |
| 1341359 | N/A | N/A | 14199 | 14214 | TATTATGTGATTGAGT | $T_{ks}A_{ks}T_{ds}T_{ds}A_{ds}T_{ds}G_{ds}T_{ds}G_{ds}A_{ds}T_{ds}T_{ks}G_{es}A_{ks}G_{es}T_k$ | 65 | 73 |
| 1341362 | N/A | N/A | 16384 | 16399 | AATCCCAACCAAACTT | $A_{ks}A_{ks}T_{ds}{}^mC_{ds}{}^mC_{ks}C_{ds}{}^mC_{ds}A_{ds}A_{ds}{}^mC_{ds}{}^mC_{ds}A_{ds}A_{ks}A_{es}{}^mC_{ks}T_{es}T_k$ | 17 | 2755 |
| 1341367 | N/A | N/A | 16129 | 16144 | TCCATAATAATAGCTC | $T_{ks}{}^mC_{ks}{}^mC_{ds}A_{ds}T_{ds}A_{ds}A_{ds}T_{ds}A_{ds}A_{ds}T_{ds}A_{ks}G_{es}{}^mC_{ks}T_{es}{}^mC_k$ | 41 | 546 |
| 1341369 | N/A | N/A | 16223 | 16238 | CTTTTTATAGACTGGG | ${}^mC_{ks}T_{ks}T_{ds}T_{ds}T_{ds}T_{ds}A_{ds}T_{ds}A_{ds}G_{ds}A_{ds}{}^mC_{ks}T_{es}G_{ks}G_{es}G_k$ | 37 | 857 |
| 1341372 | N/A | N/A | 18097 | 18112 | GAAATTGATACACCAA | $G_{ks}A_{ks}A_{ds}A_{ds}T_{ds}T_{ds}G_{ds}A_{ds}T_{ds}A_{ds}{}^mC_{ds}A_{ks}{}^mC_{es}{}^mC_{ks}A_{es}A_k$ | 68 | 315 |
| 1341373 | N/A | N/A | 17990 | 18005 | TTAGTATAGTTATCTT | $T_{ks}T_{ks}A_{ds}G_{ds}T_{ds}A_{ds}T_{ds}A_{ds}G_{ds}T_{ds}T_{ds}A_{ks}T_{es}{}^mC_{ks}T_{es}T_k$ | 33 | 2366 |
| 1341383 | N/A | N/A | 18697 | 18712 | CAAAAGACTTTGAGAC | ${}^mC_{ks}A_{ks}A_{ds}A_{ds}A_{ds}G_{ds}A_{ds}{}^mC_{ds}T_{ds}T_{ds}T_{ds}G_{ks}A_{es}G_{ks}A_{es}{}^mC_k$ | 32 | 2186 |
| 1341386 | N/A | N/A | 19910 | 19925 | CATCTTAAGATACCCA | ${}^mC_{ks}A_{ks}T_{ds}{}^mC_{ds}T_{ds}T_{ds}A_{ds}A_{ds}G_{ds}A_{ds}T_{ds}A_{ks}{}^mC_{es}{}^mC_{ks}{}^mC_{es}A_k$ | 59 | 475 |
| 1341394 | N/A | N/A | 20385 | 20400 | TAGTAATCACAAGTAA | $T_{ks}A_{ks}G_{ds}T_{ds}A_{ds}A_{ds}T_{ds}{}^mC_{ds}A_{ds}{}^mC_{ds}A_{ds}A_{ks}G_{es}T_{ks}A_{es}A_k$ | 55 | 1489 |
| 1341395 | N/A | N/A | 20112 | 20127 | ATCAAGACATTCTAGC | $A_{ks}T_{ks}{}^mC_{ds}A_{ds}A_{ds}G_{ds}A_{ds}{}^mC_{ds}A_{ds}T_{ds}T_{ds}{}^mC_{ks}T_{es}A_{ks}G_{es}{}^mC_k$ | 30 | 1488 |
| 1341397 | N/A | N/A | 20192 | 20207 | GCAGTTATTAGAAGTC | $G_{ks}{}^mC_{ks}A_{ds}G_{ds}T_{ds}T_{ds}A_{ds}T_{ds}T_{ds}A_{ds}G_{ds}A_{ks}A_{es}G_{ks}T_{es}{}^mC_k$ | 68 | 398 |
| 1341402 | N/A | N/A | 12799 | 12814 | GCTGTAAGAGTCAGTA | $G_{ks}{}^mC_{ks}T_{ds}G_{ds}T_{ds}A_{ds}A_{ds}G_{ds}A_{ds}G_{ds}T_{ds}{}^mC_{ks}A_{es}G_{ks}T_{es}A_k$ | 42 | 693 |
| 1341404 | N/A | N/A | 12499 | 12514 | AGAAATTCACCTTGAC | $A_{ks}G_{ks}A_{ds}A_{ds}A_{ds}T_{ds}T_{ds}{}^mC_{ds}A_{ds}{}^mC_{ds}{}^mC_{ds}T_{ks}T_{es}G_{ks}A_{es}{}^mC_k$ | 33 | 2284 |
| 1341408 | N/A | N/A | 20486 | 20501 | AACTTCATAGTGGACT | $A_{ks}A_{ks}{}^mC_{ds}T_{ds}T_{ds}{}^mC_{ds}A_{ds}T_{ds}A_{ds}G_{ds}T_{ds}G_{ks}G_{es}A_{ks}{}^mC_{es}T_k$ | 68 | 2555 |
| 1341416 | N/A | N/A | 13956 | 13971 | TACCTCTAAGTTAGCC | $T_{ks}A_{ks}{}^mC_{ds}{}^mC_{ds}T_{ds}{}^mC_{ds}T_{ds}A_{ds}A_{ds}G_{ds}T_{ds}T_{ks}A_{es}G_{ks}{}^mC_{es}{}^mC_k$ | 20 | 2249 |
| 1341429 | N/A | N/A | 14192 | 14207 | TGATTGAGTTCTCCAC | $T_{ks}G_{ks}A_{ds}T_{ds}T_{ds}G_{ds}A_{ds}G_{ds}T_{ds}T_{ds}{}^mC_{ds}T_{ks}{}^mC_{es}{}^mC_{ks}A_{es}{}^mC_k$ | 32 | 2116 |
| 1341535 | 1074 | 1089 | 20889 | 20904 | TGCCAAACCAATGTTT | $T_{ks}G_{ks}{}^mC_{ds}{}^mC_{ds}A_{ds}A_{ds}A_{ds}{}^mC_{ds}{}^mC_{ds}A_{ds}A_{ds}T_{ks}G_{es}T_{ks}T_{es}T_k$ | 61 | 2673 |
| 1341539 | 1310 | 1325 | 21125 | 21140 | CTTAAACCTTCCCTGT | ${}^mC_{ks}T_{ks}T_{ds}A_{ds}A_{ds}A_{ds}{}^mC_{ds}{}^mC_{ds}T_{ds}T_{ds}{}^mC_{ds}{}^mC_{ks}{}^mC_{es}T_{ks}G_{es}T_k$ | 36 | 1823 |
| 1341549 | 1330 | 1345 | 21145 | 21160 | TGGAATGCTACTTGAA | $T_{ks}G_{ks}G_{ds}A_{ds}A_{ds}T_{ds}G_{ds}{}^mC_{ds}T_{ds}A_{ds}{}^mC_{ds}T_{ks}T_{es}G_{ks}A_{es}A_k$ | 68 | 2203 |
| 1341556 | 1336 | 1351 | 21151 | 21166 | ACAGATTGGAATGCTA | $A_{ks}{}^mC_{ks}A_{ds}G_{ds}A_{ds}T_{ds}T_{ds}G_{ds}G_{ds}A_{ds}A_{ds}T_{ks}G_{es}{}^mC_{ks}T_{es}A_k$ | 49 | 1668 |
| 1341570 | 1707 | 1722 | 21522 | 21537 | TCTGGGACCAAGGATA | $T_{ks}{}^mC_{ks}T_{ds}G_{ds}G_{ds}G_{ds}A_{ds}{}^mC_{ds}{}^mC_{ds}A_{ds}A_{ds}G_{ks}G_{es}A_{ks}T_{es}A_k$ | 56 | 1830 |
| 1341572 | 1616 | 1631 | 21431 | 21446 | GGTCACCTTTCATAAT | $G_{ks}G_{ks}T_{ds}{}^mC_{ds}A_{ds}{}^mC_{ds}{}^mC_{ds}T_{ds}T_{ds}T_{ds}{}^mC_{ds}A_{ks}T_{es}A_{ks}A_{es}T_k$ | 52 | 1985 |

TABLE 41 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341579 | 1771 | 1786 | 21586 | 21601 | TAGCCAGTACAGTTCC | $T_{ks}A_{ks}G_{ds}{}^mC_{ds}{}^mC_{ds}A_{ds}G_{ds}T_{ds}A_{ds}{}^mC_{ds}A_{ds}G_{ks}T_{ks}{}^mC_{es}{}^mC_k$ | 57 | 1987 |
| 1341581 | 1716 | 1731 | 21531 | 21546 | CTAAACATCTCTGGGA | ${}^mC_{ks}T_{ks}A_{ds}A_{ds}A_{ds}{}^mC_{ds}A_{ds}T_{ds}{}^mC_{ds}T_{ds}{}^mC_{ds}T_{ks}G_{es}G_{ks}G_{es}A_k$ | 29 | 2259 |
| 1341582 | 2196 | 2211 | 22011 | 22026 | GATTAGTCTTGATGTA | $G_{ks}A_{ks}T_{ds}T_{ds}A_{ds}G_{ds}T_{ds}{}^mC_{ds}T_{ds}T_{ds}G_{ds}A_{ks}T_{es}G_{ks}T_{es}A_k$ | 56 | 1521 |
| 1341584 | 1776 | 1791 | 21591 | 21606 | TGTAATAGCCAGTACA | $T_{ks}G_{ks}T_{ds}A_{ds}A_{ds}T_{ds}A_{ds}G_{ds}{}^mC_{ds}{}^mC_{ds}A_{ds}G_{ks}T_{es}A_{ks}{}^mC_{es}A_k$ | 45 | 352 |
| 1341592 | N/A | N/A | 11578 | 11593 | GTTATTCTCTTGACAA | $G_{ks}T_{ks}T_{ds}A_{ds}T_{ds}T_{ds}{}^mC_{ds}T_{ds}{}^mC_{ds}T_{ds}T_{ds}G_{ks}A_{es}{}^mC_{ks}A_{es}A_k$ | 27 | 2575 |
| 1341602 | N/A | N/A | 16292 | 16307 | TTAGTTAGAATAGTCT | $T_{ks}T_{ks}A_{ds}G_{ds}T_{ds}T_{ds}A_{ds}G_{ds}A_{ds}A_{ds}T_{ds}A_{ks}G_{es}T_{ks}{}^mC_{es}T_k$ | 53 | 1714 |
| 1341617 | N/A | N/A | 17995 | 18010 | TGAAGTTAGTATAGTT | $T_{ks}G_{ks}A_{ds}A_{ds}G_{ds}T_{ds}T_{ds}A_{ds}G_{ds}T_{ds}A_{ds}T_{ks}A_{es}G_{ks}T_{es}T_k$ | 46 | 1405 |

TABLE 42

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^mC_{ks}A_k$ | 84 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 83 | 1526 |
| 1340984 | 1497 | 1512 | 21312 | 21327 | AGTTGCACCGTTTTGG | $A_{ks}G_{ks}T_{ks}T_{ds}G_{ds}{}^mC_{ds}A_{ds}{}^mC_{ds}{}^mC_{ds}G_{ds}T_{ds}T_{ds}T_{ks}T_{ks}G_{ks}G_e$ | 43 | 1905 |
| 1340987 | 1489 | 1504 | 21304 | 21319 | CGTTTTGGGCTAATGA | ${}^mC_{ks}G_{ks}T_{ds}T_{ds}T_{ds}T_{ds}G_{ds}G_{ds}G_{ds}{}^mC_{ds}T_{ds}A_{ds}A_{ks}T_{ks}G_{ks}A_e$ | 52 | 1282 |
| 1340990 | 1618 | 1633 | 21433 | 21448 | TCGGTCACCTTTCATA | $T_{ks}{}^mC_{ks}G_{ks}G_{ds}T_{ds}{}^mC_{ds}A_{ds}{}^mC_{ds}{}^mC_{ds}T_{ds}T_{ds}T_{ds}{}^mC_{ks}A_{ks}T_{ks}A_e$ | 72 | 116 |
| 1340997 | 1622 | 1637 | 21437 | 21452 | AGAGTCGGTCACCTTT | $A_{ks}G_{ks}A_{ks}G_{ds}T_{ds}{}^mC_{ds}G_{ds}G_{ds}T_{ds}{}^mC_{ds}A_{ds}{}^mC_{ds}{}^mC_{ks}T_{ks}T_{ks}T_e$ | 66 | 428 |
| 1341001 | 1626 | 1641 | 21441 | 21456 | AAATAGAGTCGGTCAC | $A_{ks}A_{ks}A_{ks}T_{ds}A_{ds}G_{ds}A_{ds}G_{ds}T_{ds}{}^mC_{ds}G_{ds}G_{ds}T_{ks}{}^mC_{ks}A_{ks}{}^mC_e$ | 48 | 740 |
| 1341005 | 1630 | 1645 | 21445 | 21460 | TTTAAAATAGAGTCGG | $T_{ks}T_{ks}T_{ks}A_{ds}A_{ds}A_{ds}A_{ds}T_{ds}A_{ds}G_{ds}A_{ds}G_{ds}T_{ks}{}^mC_{ks}G_{ks}G_e$ | 58 | 1051 |
| 1341018 | 1710 | 1725 | 21525 | 21540 | ATCTCTGGGACCAAGG | $A_{ks}T_{ks}{}^mC_{ks}T_{ds}{}^mC_{ds}T_{ds}G_{ds}G_{ds}G_{ds}A_{ds}{}^mC_{ds}{}^mC_{ds}A_{ks}A_{ks}G_{ks}G_e$ | 53 | 37 |
| 1341019 | 1714 | 1729 | 21529 | 21544 | AAACATCTCTGGGACC | $A_{ks}A_{ks}A_{ks}{}^mC_{ds}A_{ds}T_{ds}{}^mC_{ds}T_{ds}{}^mC_{ds}T_{ds}G_{ds}G_{ds}G_{ks}A_{ks}{}^mC_{ks}{}^mC_e$ | 48 | 2129 |
| 1341026 | 1768 | 1783 | 21583 | 21598 | CCAGTACAGTTCCTTT | ${}^mC_{ks}{}^mC_{ks}A_{ks}G_{ds}T_{ds}A_{ds}{}^mC_{ds}A_{ds}G_{ds}T_{ds}T_{ds}{}^mC_{ds}{}^mC_{ks}T_{ks}T_{ks}T_e$ | 76 | 1753 |
| 1341029 | 1750 | 1765 | 21565 | 21580 | CTGTGTTAGCTTTAAT | ${}^mC_{ks}T_{ks}G_{ks}T_{ds}G_{ds}T_{ds}T_{ds}A_{ds}G_{ds}{}^mC_{ds}T_{ds}T_{ds}T_{ks}A_{ks}A_{ks}T_e$ | 50 | 1286 |
| 1341031 | 2193 | 2208 | 22008 | 22023 | TAGTCTTGATGTAGTG | $T_{ks}A_{ks}G_{ks}T_{ds}{}^mC_{ds}T_{ds}T_{ds}G_{ds}A_{ds}T_{ds}G_{ds}T_{ds}A_{ks}G_{ks}T_{ks}G_e$ | 61 | 1288 |

TABLE 42 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341036 | 1778 | 1793 | 21593 | 21608 | TATGTAATAGCCAGTA | $T_{ks}A_{ks}T_{ks}G_{ds}T_{ds}A_{ds}A_{ds}T_{ds}A_{ds}G_{ds}{}^mC_{ds}{}^mC_{ds}A_{ks}G_{ks}T_{ks}A_e$ | 82 | 508 |
| 1341038 | 1782 | 1797 | 21597 | 21612 | TTCTTATGTAATAGCC | $T_{ks}T_{ks}{}^mC_{ks}T_{ds}T_{ds}A_{ds}T_{ds}G_{ds}T_{ds}A_{ds}A_{ds}T_{ds}A_{ks}G_{ks}{}^mC_{ks}{}^mC_e$ | 73 | 819 |
| 1341047 | 2247 | 2262 | 22062 | 22077 | ATAGTCCATGCAAAAG | $A_{ks}T_{ks}A_{ks}G_{ds}T_{ds}{}^mC_{ds}{}^mC_{ds}A_{ds}T_{ds}G_{ds}{}^mC_{ds}A_{ds}A_{ks}A_{ks}A_{ks}G_e$ | 29 | 2436 |
| 1341058 | N/A | N/A | 9330 | 9345 | CCTATATACATCCAAG | ${}^mC_{ks}{}^mC_{ks}T_{ks}A_{ds}T_{ds}A_{ds}T_{ds}A_{ds}{}^mC_{ds}A_{ds}T_{ds}{}^mC_{ds}{}^mC_{ks}A_{ks}A_{ks}G_e$ | 63 | 1771 |
| 1341063 | 1082 | 1097 | 20897 | 20912 | GCTGCTAGTGCCAAAC | $G_{ks}{}^mC_{ks}T_{ks}G_{ds}{}^mC_{ds}T_{ds}A_{ds}G_{ds}T_{ds}G_{ds}{}^mC_{ds}{}^mC_{ds}A_{ks}A_{ks}A_{ks}{}^mC_e$ | 62 | 1587 |
| 1341064 | N/A | N/A | 11855 | 11870 | TAAGCAGAATTGTGAA | $T_{ks}A_{ks}A_{ks}G_{ds}{}^mC_{ds}A_{ds}G_{ds}A_{ds}A_{ds}T_{ds}T_{ds}G_{ds}T_{ks}G_{ks}A_{ks}A_e$ | 52 | 2361 |
| 1341067 | N/A | N/A | 11571 | 11586 | TCTTGACAATGGTTGA | $T_{ks}{}^mC_{ks}T_{ks}T_{ds}G_{ds}A_{ds}{}^mC_{ds}A_{ds}A_{ds}T_{ds}G_{ds}G_{ds}T_{ks}T_{ks}G_{ks}A_e$ | 61 | 2440 |
| 1341069 | N/A | N/A | 9964 | 9979 | GTGTAAGCTGAGAGTT | $G_{ks}T_{ks}G_{ks}T_{ds}A_{ds}A_{ds}G_{ds}{}^mC_{ds}T_{ds}G_{ds}A_{ds}G_{ds}A_{ks}G_{ks}T_{ks}T_e$ | 45 | 2760 |
| 1341070 | N/A | N/A | 14199 | 14214 | TATTATGTGATTGAGT | $T_{ks}A_{ks}T_{ks}T_{ds}A_{ds}T_{ds}G_{ds}T_{ds}G_{ds}A_{ds}T_{ds}T_{ds}G_{ks}A_{ks}G_{ks}T_e$ | 51 | 73 |
| 1341073 | N/A | N/A | 15498 | 15513 | TGCTGCATTAATGCCA | $T_{ks}G_{ks}{}^mC_{ks}T_{ds}G_{ds}{}^mC_{ds}A_{ds}T_{ds}T_{ds}A_{ds}A_{ds}T_{ds}G_{ks}{}^mC_{ks}{}^mC_{ks}A_e$ | 6 | 2485 |
| 1341079 | N/A | N/A | 14918 | 14933 | TAATACATTAGCAAGC | $T_{ks}A_{ks}A_{ks}T_{ds}A_{ds}{}^mC_{ds}A_{ds}T_{ds}T_{ds}A_{ds}G_{ds}{}^mC_{ds}A_{ks}A_{ks}G_{ks}{}^mC_e$ | 35 | 2266 |
| 1341082 | N/A | N/A | 16380 | 16395 | CCAACCAAACTTCCAG | ${}^mC_{ks}{}^mC_{ks}A_{ks}A_{ds}{}^mC_{ds}{}^mC_{ds}A_{ds}A_{ds}A_{ds}{}^mC_{ds}T_{ds}T_{ds}{}^mC_{ks}{}^mC_{ks}A_{ks}G_e$ | 47 | 2539 |
| 1341083 | 1078 | 1093 | 20893 | 20908 | CTAGTGCCAAACCAAT | ${}^mC_{ks}T_{ks}A_{ks}G_{ds}T_{ds}G_{ds}{}^mC_{ds}{}^mC_{ds}A_{ds}A_{ds}A_{ds}{}^mC_{ds}{}^mC_{ks}A_{ks}A_{ks}T_e$ | 61 | 1276 |
| 1341085 | N/A | N/A | 16287 | 16302 | TAGAATAGTCTTCAGC | $T_{ks}A_{ks}G_{ks}A_{ds}A_{ds}T_{ds}A_{ds}G_{ds}T_{ds}{}^mC_{ds}T_{ds}T_{ds}{}^mC_{ks}A_{ks}G_{ks}{}^mC_e$ | 50 | 1403 |
| 1341090 | N/A | N/A | 18697 | 18712 | CAAAAGACTTTGAGAC | ${}^mC_{ks}A_{ks}A_{ks}A_{ds}A_{ds}G_{ds}A_{ds}{}^mC_{ds}T_{ds}T_{ds}T_{ds}G_{ds}A_{ks}G_{ks}A_{ks}{}^mC_e$ | 13 | 2186 |
| 1341095 | N/A | N/A | 18099 | 18114 | CTGAAATTGATACACC | ${}^mC_{ks}T_{ks}G_{ks}A_{ds}A_{ds}A_{ds}T_{ds}T_{ds}G_{ds}A_{ds}T_{ds}A_{ds}{}^mC_{ks}A_{ks}{}^mC_{ks}{}^mC_e$ | 75 | 393 |
| 1341098 | N/A | N/A | 17992 | 18007 | AGTTAGTATAGTTATC | $A_{ks}G_{ks}T_{ks}T_{ds}A_{ds}G_{ds}T_{ds}A_{ds}T_{ds}A_{ds}G_{ds}T_{ds}T_{ks}A_{ks}T_{ks}{}^mC_e$ | 47 | 1249 |
| 1341107 | N/A | N/A | 19907 | 19922 | CTTAAGATACCCAGGT | ${}^mC_{ks}T_{ks}T_{ks}A_{ds}A_{ds}G_{ds}A_{ds}T_{ds}A{}^mCi_s{}^mC_{ds}{}^mC_{ds}{}^mC_{ds}A_{ks}G_{ks}G_{ks}T_e$ | 45 | 241 |
| 1341108 | N/A | N/A | 19911 | 19926 | GCATCTTAAGATACCC | $G_{ks}{}^mC_{ks}A_{ks}T_{ds}{}^mC_{ds}T_{ds}T_{ds}A_{ds}A_{ds}G_{ds}A_{ds}T_{ds}A_{ks}{}^mC_{ks}{}^mC_{ks}{}^mC_e$ | 84 | 553 |
| 1341110 | N/A | N/A | 20383 | 20398 | GTAATCACAAGTAAGG | $G_{ks}T_{ks}A_{ks}A_{ds}T_{ds}{}^mC_{ds}A_{ds}{}^mC_{ds}A_{ds}A_{ds}G_{ds}T_{ds}A_{ks}A_{ks}G_{ks}G_e$ | 56 | 1411 |
| 1341116 | N/A | N/A | 20194 | 20209 | TTGCAGTTATTAGAAG | $T_{ks}T_{ks}G_{ks}{}^mC_{ds}A_{ds}G_{ds}T_{ds}T_{ds}A_{ds}T_{ds}T_{ds}A_{ds}G_{ks}A_{ks}A_{ks}G_e$ | 10 | 2123 |
| 1341122 | 1086 | 1101 | 20901 | 20916 | GACTGCTGCTAGTGCC | $G_{ks}A_{ks}{}^mC_{ks}T_{ds}G_{ds}{}^mC_{ds}T_{ds}G_{ds}{}^mC_{ds}T_{ds}A_{ds}G_{ds}T_{ks}G_{ks}{}^mC_{ks}{}^mC_e$ | 49 | 1899 |
| 1341123 | N/A | N/A | 12801 | 12816 | AGGCTGTAAGAGTCAG | $A_{ks}G_{ks}G_{ks}{}^mC_{ds}T_{ds}G_{ds}T_{ds}A_{ds}A_{ds}G_{ds}A_{ds}G_{ds}T_{ks}{}^mC_{ks}A_{ks}G_e$ | 49 | 2809 |
| 1341125 | N/A | N/A | 12503 | 12518 | TTGCAGAAATTCACCT | $T_{ks}T_{ks}G_{ks}{}^mC_{ds}A_{ds}G_{ds}A_{ds}A_{ds}A_{ds}T_{ds}T_{ds}{}^mC_{ds}A_{ks}{}^mC_{ks}{}^mC_{ks}T_e$ | 29 | 2528 |

TABLE 42 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341134 | N/A | N/A | 13954 | 13969 | CCTCTAAGTTAGCCCC | $^mC_{ks}{}^mC_{ks}T_{ks}{}^mC_{ds}T_{ds}A_{ds}A_{ds}G_{ds}T_{ds}T_{ds}A_{ds}G_{ds}{}^mC_{ks}{}^mC_{ks}{}^mC_{ks}{}^mC_e$ | 16 | 1084 |
| 1341136 | N/A | N/A | 14168 | 14183 | ATAGCAAGCCAACAGA | $A_{ks}T_{ks}A_{ks}G_{ds}{}^mC_{ds}A_{ds}A_{ds}G_{ds}{}^mC_{ds}{}^mC_{ds}A_{ds}A_{ds}{}^mC_{ks}A_{ks}G_{ks}A_e$ | 30 | 2633 |
| 1341144 | 1258 | 1273 | 21073 | 21088 | TAGCTTTTGTCCACCT | $T_{ks}A_{ks}G_{ks}{}^mC_{ds}T_{ds}T_{ds}T_{ds}T_{ds}G_{ds}T_{ds}{}^mC_{ds}{}^mC_{ds}A_{ks}{}^mC_{ks}{}^mC_{ks}T_e$ | 65 | 1900 |
| 1341146 | 1200 | 1215 | 21015 | 21030 | ATGTTTATGTAAGCAC | $A_{ks}T_{ks}G_{ks}T_{ds}T_{ds}T_{ds}A_{ds}T_{ds}G_{ds}T_{ds}A_{ds}A_{ds}G_{ks}{}^mC_{ks}A_{ks}{}^mC_e$ | 73 | 2622 |
| 1341148 | N/A | N/A | 14192 | 14207 | TGATTGAGTTCTCCAC | $T_{ks}G_{ks}A_{ks}T_{ds}T_{ds}G_{ds}A_{ds}G_{ds}T_{ds}T_{ds}{}^mC_{ds}T_{ds}{}^mC_{ks}{}^mC_{ks}A_{ks}{}^mC_e$ | 30 | 2116 |
| 1341149 | 606 | 621 | 10492 | 10507 | AATATGGGATGAGGTA | $A_{ks}A_{ks}T_{ks}A_{ds}T_{ds}G_{ds}G_{ds}G_{ds}A_{ds}T_{ds}G_{ds}A_{ds}G_{ks}G_{ks}T_{ks}A_e$ | 47 | 1424 |
| 1341155 | 1312 | 1327 | 21127 | 21142 | GTCTTAAACCTTCCCT | $G_{ks}T_{ks}{}^mC_{ks}T_{ds}T_{ds}A_{ds}A_{ds}A_{ds}{}^mC_{ds}{}^mC_{ds}T_{ds}T_{ds}{}^mC_{ks}{}^mC_{ks}{}^mC_{ks}T_e$ | 50 | 1901 |
| 1341157 | 1316 | 1331 | 21131 | 21146 | AACAGTCTTAAACCTT | $A_{ks}A_{ks}{}^mC_{ks}A_{ds}G_{ds}T_{ds}{}^mC_{ds}T_{ds}T_{ds}A_{ds}A_{ds}A_{ds}{}^mC_{ks}{}^mC_{ks}T_{ks}T_e$ | 57 | 188 |
| 1341161 | 1322 | 1337 | 21137 | 21152 | TACTTGAACAGTCTTA | $T_{ks}A_{ks}{}^mC_{ks}T_{ds}T_{ds}G_{ds}A_{ds}A_{ds}{}^mC_{ds}A_{ds}G_{ds}T_{ds}{}^mC_{ks}T_{ks}T_{ks}A_e$ | 65 | 656 |
| 1341162 | 1333 | 1348 | 21148 | 21163 | GATTGGAATGCTACTT | $G_{ks}A_{ks}T_{ks}T_{ds}G_{ds}G_{ds}A_{ds}A_{ds}T_{ks}G_{ds}{}^mC_{ds}T_{ds}A_{ks}{}^mC_{ks}T_{ks}T_e$ | 59 | 1435 |
| 1341169 | 1326 | 1341 | 21141 | 21156 | ATGCTACTTGAACAGT | $A_{ks}T_{ks}G_{ks}{}^mC_{ds}T_{ds}A_{ds}{}^mC_{ds}T_{ds}T_{ds}G_{ds}A_{ds}A_{ds}{}^mC_{ks}A_{ks}G_{ks}T_e$ | 50 | 967 |
| 1341220 | 1342 | 1357 | 21157 | 21172 | ATGGCTACAGATTGGA | $A_{ks}T_{ks}G_{ks}G_{ds}{}^mC_{ds}T_{ds}A_{ds}{}^mC_{ds}A_{ds}G_{ds}A_{ds}T_{ds}T_{ks}G_{ks}G_{ks}A_e$ | 65 | 111 |
| 1341283 | 1356 | 1371 | 21171 | 21186 | TGATATTCTGTGGCAT | $T_{ks}G_{ks}A_{ks}T_{ds}A_{ds}T_{ds}T_{ds}{}^mC_{ds}T_{ds}G_{ds}T_{ds}G_{ds}G_{ks}{}^mC_{ks}A_{ks}T_e$ | 74 | 1124 |
| 1341309 | 1352 | 1367 | 21167 | 21182 | ATTCTGTGGCATGGCT | $A_{ks}T_{ks}{}^mC_{ds}T_{ds}G_{ds}T_{ds}G_{ds}G_{ds}{}^mC_{ds}A_{ds}T_{ds}G_{ks}G_{ks}{}^mC_{ks}T_e$ | 68 | 2328 |
| 1341366 | 1364 | 1379 | 21179 | 21194 | GTTCTTGTTGATATTC | $G_{ks}T_{ks}T_{ks}{}^mC_{ds}T_{ds}T_{ds}G_{ds}T_{ds}T_{ds}G_{ds}A_{ds}T_{ds}A_{ks}T_{ks}T_{ks}{}^mC_e$ | 69 | 1436 |
| 1341420 | 1418 | 1433 | 21233 | 21248 | TTGAGATAAAGCTGCC | $T_{ks}T_{ks}G_{ks}A_{ds}G_{ds}A_{ds}T_{ds}A_{ds}A_{ds}A_{ds}G_{ds}{}^mC_{ds}T_{ks}G_{ks}{}^mC_{ks}{}^mC_e$ | 43 | 1670 |
| 1341422 | 1389 | 1404 | 21204 | 21219 | TCTCTTAGCTGTGCAC | $T_{ks}{}^mC_{ks}T_{ks}{}^mC_{ds}T_{ds}T_{ds}A_{ds}G_{ds}{}^mC_{ds}T_{ds}G_{ds}T_{ds}G_{ks}{}^mC_{ks}A_{ks}{}^mC_e$ | 69 | 346 |
| 1341423 | 1422 | 1437 | 21237 | 21252 | CAGGTTGAGATAAAGC | $^mC_{ks}A_{ks}G_{ks}G_{ds}T_{ds}T_{ds}G_{ds}A_{ds}G_{ds}A_{ds}T_{ds}A_{ds}A_{ks}A_{ks}G_{ks}{}^mC_e$ | 63 | 1982 |
| 1341430 | 1493 | 1508 | 21308 | 21323 | GCACCGTTTTGGGCTA | $G_{ks}{}^mC_{ks}A_{ks}{}^mC_{ds}{}^mC_{ds}G_{ds}T_{ds}T_{ds}T_{ds}T_{ds}G_{ds}G_{ds}G_{ks}{}^mC_{ks}T_{ks}A_e$ | 45 | 1593 |
| 1341438 | 1504 | 1519 | 21319 | 21334 | AGAATAGAGTTGCACC | $A_{ks}G_{ks}A_{ks}A_{ds}T_{ds}A_{ds}G_{ds}A_{ds}G_{ds}T_{ds}T_{ds}G_{ds}{}^mC_{ks}A_{ks}{}^mC_{ks}{}^mC_e$ | 58 | 426 |
| 1341440 | 1461 | 1476 | 21276 | 21291 | CTAGGGAAATCTTTCA | $^mC_{ks}T_{ks}A_{ks}G_{ds}G_{ds}G_{ds}A_{ds}A_{ds}A_{ds}T_{ds}{}^mC_{ds}T_{ds}T_{ks}T_{ks}{}^mC_{ks}A_e$ | 55 | 659 |
| 1341443 | 1614 | 1629 | 21429 | 21444 | TCACCTTTCATAATGT | $T_{ks}{}^mC_{ks}A_{ks}{}^mC_{ds}{}^mC_{ds}T_{ds}T_{ds}T_{ds}{}^mC_{ds}A_{ds}T_{ds}A_{ds}A_{ks}T_{ks}G_{ks}T_e$ | 41 | 2109 |
| 1341444 | 805 | 820 | 15686 | 15701 | GTAAGTATTCCATCTA | $G_{ks}T_{ks}A_{ks}A_{ds}G_{ds}T_{ds}A_{ds}T_{ds}T_{ds}{}^mC_{ds}{}^mC_{ds}A_{ds}T_{ks}{}^mC_{ks}T_{ks}A_e$ | 39 | 1038 |
| 1341445 | 613 | 628 | N/A | N/A | CTGGAACAATATGGGA | $^mC_{ks}T_{ks}G_{ks}G_{ds}A_{ds}A_{ds}{}^mC_{ds}A_{ds}A_{ds}T_{ds}A_{ds}T_{ds}G_{ks}G_{ks}G_{ks}A_e$ | 36 | 1969 |

TABLE 42 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341452 | 1718 | 1733 | 21533 | 21548 | GTCTAAACATCTCTGG | $G_{ks}T_{ks}{}^mC_{ks}T_{ds}A_{ds}A_{ds}A_{ds}{}^mC_{ds}A_{ds}G_{ds}T_{ds}A_{ds}{}^mC_{ks}A_{ks}G_{ks}T_e$ | 49 | 429 |
| 1341453 | 1774 | 1789 | 21589 | 21604 | TAATAGCCAGTACAGT | $T_{ks}A_{ks}A_{ks}T_{ds}A_{ds}G_{ds}{}^mC_{ds}{}^mC_{ds}A_{ds}G_{ds}T_{ds}A_{ds}{}^mC_{ks}A_{ks}G_{ks}T_e$ | 64 | 196 |
| 1341459 | 1074 | 1089 | 20889 | 20904 | TGCCAAACCAATGTTT | $T_{ks}G_{ks}{}^mC_{ks}{}^mC_{ds}A_{ds}A_{ds}A_{ds}{}^mC_{ds}{}^mC_{ds}A_{ds}A_{ds}T_{ds}G_{ks}T_{ks}T_{ks}T_e$ | 43 | 2673 |
| 1341461 | N/A | N/A | 9511 | 9526 | AATATTGAGGCACTGG | $A_{ks}A_{ks}T_{ks}A_{ds}T_{ds}T_{ds}G_{ds}A_{ds}G_{ds}G_{ds}{}^mC_{ds}A_{ds}{}^mC_{ks}T_{ks}G_{ks}G_e$ | 36 | 1538 |
| 1341462 | N/A | N/A | 9598 | 9613 | ATGTGAAGAGCTGGTA | $A_{ks}T_{ks}G_{ks}T_{ds}G_{ds}A_{ks}A_{ds}G_{ds}A_{ds}G_{ds}{}^mC_{ds}T_{ds}G_{ks}G_{ks}T_{ks}A_e$ | 56 | 527 |
| 1341464 | 2257 | 2272 | 22072 | 22087 | AAACAAGAGGATAGTC | $A_{ks}A_{ks}A_{ks}{}^mC_{ds}A_{ds}A_{ds}G_{ds}A_{ds}G_{ds}G_{ds}A_{ks}T_{ks}A_{ks}G_{ks}T_{ks}{}^mC_e$ | 45 | 744 |
| 1341465 | 2186 | 2201 | 22001 | 22016 | GATGTAGTGGGAGTCG | $G_{ks}A_{ks}T_{ks}G_{ds}T_{ds}A_{ds}G_{ds}T_{ds}G_{ds}G_{ds}G_{ds}A_{ds}G_{ks}T_{ks}{}^mC_{ks}G_e$ | 42 | 743 |
| 1341470 | N/A | N/A | 12416 | 12431 | ACGGTGATCAAATGTA | $A_{ks}{}^mC_{ks}G_{ks}G_{ds}T_{ds}G_{ds}A_{ds}T_{ds}{}^mC_{ds}A_{ds}A_{ds}A_{ds}T_{ks}G_{ks}T_{ks}A_e$ | 41 | 2205 |
| 1341472 | N/A | N/A | 12426 | 12441 | CAGGGTGGTAACGGTG | ${}^mC_{ks}A_{ks}G_{ks}G_{ds}G_{ds}T_{ds}G_{ds}G_{ds}T_{ds}A_{ds}A_{ds}{}^mC_{ds}G_{ks}G_{ks}T_{ks}G_e$ | 39 | 2729 |
| 1341478 | N/A | N/A | 17997 | 18012 | TATGAAGTTAGTATAG | $T_{ks}A_{ks}T_{ks}G_{ds}A_{ds}A_{ds}G_{ds}T_{ds}T_{ds}A_{ds}G_{ds}T_{ds}A_{ks}T_{ks}A_{ks}G_e$ | 13 | 1560 |
| 1341480 | N/A | N/A | 16134 | 16149 | GATGCTCCATAATAAT | $G_{ks}A_{ks}T_{ks}G_{ds}{}^mC_{ds}T_{ds}{}^mC_{ds}{}^mC_{ds}A_{ds}T_{ds}A_{ds}A_{ds}T_{ks}A_{ks}A_{ks}T_e$ | 15 | 2049 |
| 1341486 | N/A | N/A | 16124 | 16139 | AATAATAGCTCTATTG | $A_{ks}A_{ks}T_{ks}A_{ds}A_{ds}T_{ds}A_{ds}G_{ds}{}^mC_{ds}T_{ds}{}^mC_{ds}T_{ds}A_{ks}T_{ks}T_{ks}G_e$ | 3 | 2410 |
| 1341494 | N/A | N/A | 19915 | 19930 | GAGTGCATCTTAAGAT | $G_{ks}A_{ks}G_{ks}T_{ds}G_{ds}{}^mC_{ds}A_{ds}T_{ds}{}^mC_{ds}T_{ds}T_{ds}A_{ds}A_{ks}G_{ks}A_{ks}T_e$ | 34 | 2256 |
| 1341496 | N/A | N/A | 17987 | 18002 | GTATAGTTATCTTCTC | $G_{ks}T_{ks}A_{ks}T_{ds}A_{ds}G_{ds}T_{ds}T_{ds}A_{ks}T_{ds}{}^mC_{ds}T_{ds}T_{ks}{}^mC_{ks}T_{ks}{}^mC_e$ | 68 | 937 |
| 1341499 | N/A | N/A | 20489 | 20504 | CATAACTTCATAGTGG | ${}^mC_{ks}A_{ks}T_{ks}A_{ds}A_{ds}{}^mC_{ds}T_{ds}T_{ds}{}^mC_{ds}A_{ds}T_{ds}A_{ds}G_{ks}T_{ks}G_{ks}G_e$ | 16 | 866 |
| 1341501 | N/A | N/A | 20109 | 20124 | AAGACATTCTAGCCTG | $A_{ks}A_{ks}G_{ks}A_{ds}{}^mC_{ds}A_{ds}T_{ds}T_{ds}{}^mC_{ds}T_{ds}A_{ds}G_{ds}{}^mC_{ks}{}^mC_{ks}T_{ks}G_e$ | 40 | 2744 |
| 1341506 | N/A | N/A | 20119 | 20134 | TTACAGCATCAAGACA | $T_{ks}T_{ks}A_{ks}{}^mC_{ds}A_{ds}G_{ds}{}^mC_{ds}A_{ds}T_{ds}{}^mC_{ds}A_{ds}A_{ds}G_{ks}A_{ks}{}^mC_{ks}A_e$ | 44 | 2409 |
| 1341517 | N/A | N/A | 20479 | 20494 | TAGTGGACTTCATTAG | $T_{ks}A_{ks}G_{ks}T_{ds}G_{ds}G_{ds}A_{ds}{}^mC_{ds}T_{ds}T_{ds}{}^mC_{ds}A_{ds}T_{ks}T_{ks}A_{ks}G_e$ | 22 | 2351 |

TABLE 43

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}T_{ds}A_{ds}A_{ds}G_{ds}T_{ks}{}^mC_{ks}A_k$ | 88 | 121 |
| 1246023 | N/A | N/A | 5046 | 5061 | GAGTGAATCATTCAGT | $G_{ks}A_{ks}G_{ks}T_{ds}G_{ds}A_{ds}A_{ksds}T_{ds}{}^mC_{ds}A_{ds}T_{ds}T_{ds}{}^mC_{ds}A_{ks}G_{ks}T_k$ | 84 | 1526 |

TABLE 43 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1340982 | 1490 | 1505 | 21305 | 21320 | CCGTTTTGGGCTAATG | $^mC_{ks}{}^mC_{ks}G_{ks}T_{ds}T_{ds}T_{ds}T_{ds}G_{ds}G_{ds}G_{ds}{}^mC_{ds}T_{ds}A_{ks}A_{ks}T_{ks}G_e$ | 69 | 1360 |
| 1340988 | 1494 | 1509 | 21309 | 21324 | TGCACCGTTTTGGGCT | $T_{ks}G_{ks}{}^mC_kA_{ds}{}^mC_{ds}{}^mC_{ds}G_{ds}T_{ds}T_{ds}T_{ds}G_{ds}G_{ds}G_{ks}G_{ks}{}^mC_{ks}T_e$ | 43 | 1671 |
| 1340993 | 1619 | 1634 | 21434 | 21449 | GTCGGTCACCTTTCAT | $G_{ks}T_{ks}{}^mC_{ks}G_{ds}G_{ds}T_{ds}{}^mC_{ds}A_{ds}{}^mC_{ds}{}^mC_{ds}T_{ds}T_{ds}T_{ks}{}^mC_{ks}A_{ks}T_e$ | 68 | 194 |
| 1340994 | 1598 | 1613 | 21413 | 21428 | ATCTTATAAGACTATA | $A_{ks}T_{ks}{}^mC_{ks}T_{ds}T_{ds}A_{ds}T_{ds}A_{ds}A_{ds}G_{ds}A_{ds}{}^mC_{ds}T_{ks}A_{ks}T_{ks}A_e$ | 53 | 2661 |
| 1341006 | 1627 | 1642 | 21442 | 21457 | AAAATAGAGTCGGTCA | $A_{ks}A_{ks}A_{ks}A_{ds}T_{ds}A_{ds}G_{ds}A_{ds}G_{ds}T_{ds}{}^mC_{ds}G_{Ds}G_{ks}T_{ks}{}^mC_{ks}A_e$ | 65 | 817 |
| 1341008 | 808 | 823 | 15689 | 15704 | TTGGTAAGTATTCCAT | $T_{ks}T_{ks}G_{ks}G_{ds}T_{ds}A_{ds}A_{ds}G_{ds}T_{ds}A_{ds}T_{ds}T_{ds}{}^mC_{ks}{}^mC_{ks}A_{ks}T_e$ | 28 | 2750 |
| 1341009 | 1623 | 1638 | 21438 | 21453 | TAGAGTCGGTCACCTT | $T_{ks}A_{ks}Cr_{ks}A_{ds}G_{ds}T_{ds}{}^mC_{ds}G_{ds}G_{ds}T_{ds}{}^mC_{ds}A_{ds}{}^mC_{ks}{}^mC_{ks}T_{ks}T_e$ | 59 | 506 |
| 1341012 | 1719 | 1734 | 21534 | 21549 | TGTCTAAACATCTCTG | $T_{ks}G_{ks}T_{ks}{}^mC_{ds}T_{ds}A_{ds}A_{ds}A_{ds}{}^mC_{ds}A_{ds}T_{ds}{}^mC_{ds}T_{ks}{}^mC_{ks}T_{ks}G_e$ | 69 | 507 |
| 1341014 | 1711 | 1726 | 21526 | 21541 | CATCTCTGGGACCAAG | $^mC_{ks}A_{ks}T_{ks}{}^mC_{ds}T_{ds}{}^mC_{ds}T_{ds}G_{ds}G_{ds}G_{ds}A_{ds}{}^mC_{ds}{}^mC_{ks}A_{ks}A_{ks}G_e$ | 42 | 117 |
| 1341016 | 1715 | 1730 | 21530 | 21545 | TAAACATCTCTGGGAC | $T_{ks}A_{ks}A_{ks}A_{ds}{}^mC_{ds}A_{ds}T_{ds}{}^mC_{ds}T_{ds}{}^mC_{ds}T_{ds}G_{ds}G_{ds}G_{ks}A_{ks}{}^mC_e$ | 32 | 351 |
| 1341020 | 1017 | 1032 | 20832 | 20847 | CAGCATTGATTCGAAA | $^mC_{ks}A_{ks}G_{ks}{}^mC_{ds}A_{ds}T_{ds}T_{ds}G_{ds}A_{ds}T_{ds}T_{ds}{}^mC_{ds}G_{ks}A_{ks}A_{ks}A_e$ | 53 | 263 |
| 1341025 | 1775 | 1790 | 21590 | 21605 | GTAATAGCCAGTACAG | $G_{ks}T_{ks}A_{ks}A_{ds}T_{ds}A_{ds}G_{ds}{}^mC_{ds}{}^mC_{ds}A_{ds}G_{ds}T_{ds}A_{ks}{}^mC_{ks}A_{ks}G_e$ | 62 | 274 |
| 1341027 | 1751 | 1766 | 21566 | 21581 | CCTGTGTTAGCTTTAA | $^mC_{ks}{}^mC_{ks}T_{ks}G_{ds}T_{ds}G_{ds}T_{ds}T_{ds}A_{ds}G_{ds}{}^mC_{ds}T_{ds}T_{ks}T_{ks}A_{ks}A_e$ | 66 | 1364 |
| 1341028 | 1770 | 1785 | 21585 | 21600 | AGCCAGTACAGTTCCT | $A_{ks}G_{ks}{}^mC_{ks}{}^mC_{ds}A_{ds}G_{ds}T_{ds}A_{ds}{}^mC_{ds}A_{ds}G_{ds}T_{ds}T_{ks}{}^mC_{ks}{}^mC_{ks}T_e$ | 59 | 1909 |
| 1341032 | 1779 | 1794 | 21594 | 21609 | TTATGTAATAGCCAGT | $T_{ks}T_{ks}A_{ks}T_{ds}G_{ds}T_{ds}A_{ds}A_{ds}T_{ds}A_{ds}G_{ds}{}^mC_{ds}{}^mC_{ks}A_{ks}G_{ks}T_e$ | 77 | 586 |
| 1341035 | 2187 | 2202 | 22002 | 22017 | TGATGTAGTGGGAGTC | $T_{ks}G_{ks}A_{ks}T_{ds}G_{ds}T_{ds}A_{ds}G_{ds}T_{ds}G_{ds}G_{ds}G_{ds}A_{ks}G_{ks}T_{ks}{}^mC_e$ | 77 | 820 |
| 1341037 | 1783 | 1798 | 21598 | 21613 | TTTCTTATGTAATAGC | $T_{ks}T_{ks}T_{ks}{}^mC_{ds}T_{ds}T_{ds}A_{ds}T_{ds}G_{ds}T_{ds}A_{ds}A_{ds}T_{ks}A_{ks}G_{ks}{}^mC_e$ | 60 | 2128 |
| 1341041 | 1079 | 1094 | 20894 | 20909 | GCTAGTGCCAAACCAA | $G_{ks}{}^mC_{ks}T_{ks}A_{ds}G_{ds}T_{ds}G_{ds}{}^mC_{ds}{}^mC_{ds}A_{ds}A_{ds}A_{ds}{}^mC_{ks}{}^mC_{ks}A_{ks}A_e$ | 70 | 1354 |
| 1341046 | 2250 | 2265 | 22065 | 22080 | AGGATAGTCCATGCAA | $A_{ks}G_{ks}G_{ks}A_{ds}T_{ds}A_{ds}G_{ds}T_{ds}{}^mC_{ds}{}^mC_{ds}A_{ds}T_{ds}G_{ks}{}^mC_{ks}A_{ks}A_e$ | 61 | 2690 |
| 1341050 | N/A | N/A | 9332 | 9347 | ATCCTATATACATCCA | $A_{ks}T_{ks}{}^mC_{ks}{}^mC_{ds}T_{ds}A_{ds}T_{ds}A_{ds}T_{ds}A_{ds}{}^mC_{ds}A_{ds}T_{ks}{}^mC_{ks}{}^mC_{ks}A_e$ | 75 | 1927 |
| 1341052 | N/A | N/A | 9966 | 9981 | TAGTGTAAGCTGAGAG | $T_{ks}A_{ks}G_{ks}T_{ds}G_{ds}T_{ds}A_{ds}A_{ds}G_{ds}{}^mC_{ds}T_{ds}G_{ds}A_{ks}G_{ks}S_{ks}G_e$ | 82 | 1852 |
| 1341054 | N/A | N/A | 9601 | 9616 | CATATGTGAAGAGCTG | $^mC_{ks}A_{ks}T_{ks}A_{ds}T_{ds}G_{ds}T_{ds}G_{ds}A_{ds}A_{ds}G_{ds}A_{ds}G_{ks}{}^mC_{ks}T_{ks}G_e$ | 50 | 683 |
| 1341055 | N/A | N/A | 9514 | 9529 | ACTAATATTGAGGCAC | $A_{ks}{}^mC_{ks}T_{ks}A_{ds}A_{ds}T_{ds}A_{ds}T_{ds}T_{ds}G_{ds}A_{ds}G_{ds}G_{ks}{}^mC_{ks}A_{ks}{}^mC_e$ | 62 | 1772 |
| 1341061 | N/A | N/A | 12419 | 12434 | GTAACGGTGATCAAAT | $G_{ks}T_{ks}A_{ks}A_{ds}{}^mC_{ds}G_{ds}G_{ds}T_{ds}G_{ds}A_{ds}T_{ds}{}^mC_{ds}A_{ks}A_{ks}A_{ks}T_e$ | 32 | 2345 |

TABLE 43 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341062 | N/A | N/A | 11548 | 11563 | TCTCTTGACAATGGTT | $T_{ks}{}^mC_{ks}T_{ks}{}^mC_{ds}T_{ds}T_{ds}G_{ds}A_{ds}{}^mC_{ds}A_{ds}A_{ds}T_{ds}G_{ks}G_{ks}T_{ks}T_e$ | 84 | 1389 |
| | | | 11573 | 11588 | | | 100 | |
| 1341080 | N/A | N/A | 16289 | 16304 | GTTAGAATAGTCTTCA | $G_{ks}T_{ks}T_{ks}A_{ds}G_{ds}A_{ds}A_{ds}T_{ds}A_{ds}G_{ds}T_{ds}{}^mC_{ds}T_{ks}T_{ks}{}^mC_{ks}A_e$ | 71 | 1481 |
| 1341087 | N/A | N/A | 16382 | 16397 | TCCCAACCAAACTTCC | $T_{ks}{}^mC_{ks}{}^mC_{ks}{}^mC_{ds}A_{ds}A_{ds}{}^mC_{ds}{}^mC_{ds}A_{ds}A_{ds}A_{ds}{}^mC_{ds}T_{ks}T_{ks}{}^mC_{ks}{}^mC_e$ | 24 | 2026 |
| 1341088 | N/A | N/A | 16127 | 16142 | CATAATAATAGCTCTA | ${}^mC_{ks}A_{ks}T_{ks}A_{ds}A_{ds}T_{ds}A_{ds}A_{ds}T_{ds}A_{ds}G_{ds}{}^mC_{ds}T_{ks}{}^mC_{ks}T_{ks}A_e$ | 55 | 2511 |
| 1341093 | 1083 | 1098 | 20898 | 20913 | TGCTGCTAGTGCCAAA | $T_{ks}G_{ks}{}^mC_{ks}T_{ds}G_{ds}{}^mC_{ds}T_{ds}A_{ds}G_{ds}T_{ds}G_{ds}{}^mC_{ds}{}^mC_{ks}A_{ks}A_{ks}A_e$ | 56 | 1665 |
| 1341097 | N/A | N/A | 17989 | 18004 | TAGTATAGTTATCTTC | $T_{ks}A_{ks}G_{ks}T_{ds}A_{ds}T_{ds}A_{ds}G_{ds}T_{ds}T_{ds}A_{ds}T_{ds}{}^mC_{ks}T_{ks}T_{ks}{}^mC_e$ | 28 | 1093 |
| 1341099 | N/A | N/A | 17994 | 18009 | GAAGTTAGTATAGTTA | $G_{ks}A_{ks}A_{ks}G_{ds}T_{ds}T_{ds}A_{ds}G_{ds}T_{ds}A_{ds}T_{ds}A_{ds}G_{ks}T_{ks}T_{ks}A_e$ | 75 | 1327 |
| 1341100 | N/A | N/A | 19908 | 19923 | TCTTAAGATACCCAGG | $T_{ks}{}^mC_{ks}T_{ks}T_{ds}A_{ds}A_{ds}G_{ds}A_{ds}T_{ds}A_{ds}{}^mC_{ds}{}^mC_{ds}{}^mC_{ks}A_{ks}G_{ks}G_e$ | 48 | 319 |
| 1341105 | N/A | N/A | 19912 | 19927 | TGCATCTTAAGATACC | $T_{ks}G_{ks}{}^mC_{ks}A_{ds}T_{ds}{}^mC_{ds}T_{ds}T_{ds}A_{ds}A_{ds}G_{ds}A_{ds}T_{ks}A_{ks}{}^mC_{ks}{}^mC_e$ | 37 | 2050 |
| 1341113 | N/A | N/A | 20385 | 20400 | TAGTAATCACAAGTAA | $T_{ks}A_{ks}G_{ks}T_{ds}A_{ds}A_{ds}T_{ds}{}^mC_{ds}A_{ds}{}^mC_{ds}A_{ds}A_{ds}G_{ks}T_{ks}A_{ks}A_e$ | 65 | 1489 |
| 1341114 | N/A | N/A | 20112 | 20127 | ATCAAGACATTCTAGC | $AT_{ks}{}^mC_{ks}A_{ds}A_{ds}G_{ds}A_{ds}{}^mC_{ds}A_{ds}T_{ds}T_{ds}{}^mC_{ds}T_{ks}A_{ks}G_{ks}{}^mC_e$ | 52 | 1488 |
| 1341119 | 1088 | 1103 | 20903 | 20918 | TTGACTGCTGCTAGTG | $T_{ks}T_{ks}G_{ks}A_{ds}{}^mC_{ds}T_{ds}G_{ds}{}^mC_{ds}T_{ds}G_{ds}{}^mC_{ds}T_{ds}A_{ks}G_{ks}T_{ks}G_e$ | 50 | 28 |
| 1341127 | N/A | N/A | 20482 | 20497 | TCATAGTGGACTTCAT | $T_{ks}{}^mC_{ks}A_{ks}T_{ds}A_{ds}G_{ds}T_{ds}G_{ds}G_{ds}A_{ds}{}^mC_{ds}T_{ks}T_{ks}{}^mC_{ks}A_{ks}T_e$ | 54 | 633 |
| 1341130 | N/A | N/A | 13956 | 13971 | TACCTCTAAGTTAGCC | $T_{ks}A_{ks}{}^mC_{ks}{}^mC_{ds}T_{ds}{}^mC_{ds}T_{ds}A_{ds}A_{ds}G_{ds}T_{ds}T_{ds}A_{ks}G_{ks}{}^mC_{ks}{}^mC_e$ | 30 | 2249 |
| 1341132 | N/A | N/A | 14194 | 14209 | TGTGATTGAGTTCTCC | $T_{ks}G_{ks}T_{ks}G_{ds}A_{ds}T_{ds}T_{ds}G_{ds}A_{ds}G_{ds}T_{ds}T_{ds}{}^mC_{ks}T_{ks}{}^mC_{ks}{}^mC_e$ | 52 | 2020 |
| 1341133 | N/A | N/A | 14170 | 14185 | GAATAGCAAGCCAACA | $G_{ks}A_{ks}A_{ks}T_{ds}A_{ds}G_{ds}{}^mC_{ds}A_{ds}A_{ds}G_{ds}{}^mC_{ds}{}^mC_{ds}A_{ks}A_{ks}{}^mC_{ks}A_e$ | 30 | 1708 |
| 1341141 | 1259 | 1274 | 21074 | 21089 | GTAGCTTTTGTCCACC | $G_{ks}T_{ks}A_{ks}G_{ds}{}^mC_{ds}T_{ds}T_{ds}T_{ds}T_{ds}G_{ds}T_{ds}{}^mC_{ds}{}^mC_{ks}A_{ks}{}^mC_{ks}{}^mC_e$ | 67 | 1978 |
| 1341147 | 1202 | 1217 | 21017 | 21032 | GTATGTTTATGTAAGC | $G_{ks}T_{ks}A_{ks}T_{ds}G_{ds}T_{ds}T_{ds}T_{ds}A_{ds}T_{ds}G_{ds}T_{ds}A_{ks}A_{ks}G_{ks}{}^mC_e$ | 71 | 1511 |
| 1341152 | 1317 | 1332 | 21132 | 21147 | GAACAGTCTTAAACCT | $G_{ks}A_{ks}A_{ks}{}^mC_{ds}A_{ds}G_{ds}T_{ds}{}^mC_{ds}T_{ds}T_{ds}A_{ds}A_{ds}A_{ks}{}^mC_{ks}{}^mC_{ks}T_e$ | 64 | 266 |
| 1341159 | 1313 | 1328 | 21128 | 21143 | AGTCTTAAACCTTCCC | $A_{ks}G_{ks}T_{ks}{}^mC_{ds}T_{ds}T_{ds}A_{ds}A_{ds}A_{ds}{}^mC_{ds}{}^mC_{ds}T_{ds}T_{ks}{}^mC_{ks}{}^mC_{ks}{}^mC_e$ | 61 | 1979 |
| 1341163 | 1327 | 1342 | 21142 | 21157 | AATGCTACTTGAACAG | $A_{ks}A_{ks}T_{ks}G_{ds}{}^mC_{ds}T_{ds}A_{ds}{}^mC_{ds}T_{ds}T_{ds}G_{ds}A_{ds}A_{ks}{}^mC_{ks}A_{ks}G_e$ | 50 | 1045 |
| 1341168 | 1323 | 1338 | 21138 | 21153 | CTACTTGAACAGTCTT | ${}^mC_{ks}T_{ks}A_{ks}{}^mC_{ds}T_{ds}T_{ds}G_{ds}A_{ds}A_{ds}{}^mC_{ds}A_{ds}G_{ds}T_{ks}{}^mC_{ks}T_{ks}T_e$ | 71 | 734 |
| 1341205 | 1335 | 1350 | 21150 | 21165 | CAGATTGGAATGCTAC | ${}^mC_{ks}A_{ks}G_{ks}A_{ds}T_{ds}T_{ds}G_{ds}G_{ds}A_{ds}A_{ds}T_{ds}G_{ds}{}^mC_{ks}T_{ks}A_{ks}{}^mC_e$ | 61 | 1590 |
| 1341216 | 1344 | 1359 | 21159 | 21174 | GCATGGCTACAGATTG | $G_{ks}{}^mC_{ks}A_{ks}T_{ds}G_{ds}G_{ds}{}^mC_{ds}T_{ds}A_{ds}{}^mC_{ds}A_{ds}G_{ds}A_{ks}T_{ks}T_{ks}G_e$ | 67 | 267 |

TABLE 43 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341223 | 696 | 711 | 12114 | 12129 | GACATGAGGTTTTGAT | $G_{ks}A_{ks}{}^mC_{ks}A_{ds}T_{ds}G_{ds}A_{ds}G_{ds}G_{ds}T_{ds}T_{ds}T_{ds}TIc_sG_{ks}A_{ks}T_e$ | 55 | 647 |
| 1341244 | 1353 | 1368 | 21168 | 21183 | TATTCTGTGGCATGGC | $T_{ks}A_{ks}T_{ks}T_{ds}{}^mC_{ds}T_{ds}G_{ds}T_{ds}G_{ds}{}^mC_{ds}A_{ds}T_{ks}G_{ks}G_{ks}{}^mC_e$ | 74 | 890 |
| 1341335 | 1357 | 1372 | 21172 | 21187 | TTGATATTCTGTGGCA | $T_{ks}T_{ks}G_{ks}A_{ds}T_{ds}A_{ds}T_{ds}T_{ds}{}^mC_{ds}T_{ds}G_{ds}T_{ds}G_{ks}G_{ks}{}^mC_{ks}A_e$ | 76 | 1202 |
| 1341353 | 1366 | 1381 | 21181 | 21196 | GTGTTCTTGTTGATAT | $G_{ks}T_{ks}G_{ks}T_{ds}T_{ds}{}^mC_{ds}T_{ds}T_{ds}G_{ds}T_{ds}T_{ds}G_{ds}A_{ks}T_{ks}A_{ks}T_e$ | 66 | 1514 |
| 1341413 | 1391 | 1406 | 21206 | 21221 | GATCTCTTAGCTGTGC | $G_{ks}A_{ks}T_{ks}{}^mC_{ds}T_{ds}{}^mC_{ds}T_{ds}T_{ds}A_{ds}G_{ds}{}^mC_{ds}T_{ds}G_{ks}T_{ks}G_{ks}{}^mC_e$ | 70 | 502 |
| 1341424 | 794 | 809 | 15675 | 15690 | ATCTATCAGACTTCTT | $A_{ks}T_{ks}{}^mC_{ks}T_{ds}A_{ds}T_{ds}{}^mC_{ds}A_{ds}G_{ds}A_{ds}{}^mC_{ds}T_{ds}T_{ds}{}^mC_{ds}T_{ks}T_e$ | 51 | 2728 |
| 1341425 | 1423 | 1438 | 21238 | 21253 | CCAGGTTGAGATAAAG | ${}^mC_{ks}{}^mC_{ks}A_{ks}G_{ds}G_{ds}T_{ds}T_{ds}G_{ds}A_{ds}G_{ds}A_{ds}T_{ds}A_{ks}A_{ks}A_{ks}G_e$ | 51 | 33 |
| 1341433 | 1464 | 1479 | 21279 | 21294 | AGGCTAGGGAAATCTT | $A_{ks}G_{ks}G_{ks}{}^mC_{ds}T_{ds}A_{ds}G_{ds}G_{ds}G_{ds}A_{ds}A_{ds}A_{ds}T_{ks}{}^mC_{ks}T_{ks}T_e$ | 55 | 892 |
| 1341434 | 1419 | 1434 | 21234 | 21249 | GTTGAGATAAAGCTGC | $G_{ks}T_{ks}T_{ks}G_{ds}A_{ds}G_{ds}Aci_sT_{ds}A_{ds}A_{ds}A_{ds}G_{ds}{}^mC_{ks}T_{ks}G_{ks}{}^mC_e$ | 59 | 1748 |
| 1341439 | 1615 | 1630 | 21430 | 21445 | GTCACCTTTCATAATG | $G_{ks}T_{ks}{}^mC_{ks}A_{ds}{}^mC_{ds}{}^mC_{ds}T_{ds}T_{ds}T_{ds}{}^mC_{ds}A_{ds}T_{ds}A_{ks}A_{ks}T_{ks}G_e$ | 21 | 1907 |
| 1341442 | 1498 | 1513 | 21313 | 21328 | GAGTTGCACCGTTTTG | $G_{ks}A_{ks}G_{ks}T_{ds}T_{ds}G_{ds}{}^mC_{ds}A_{ds}{}^mC_{ds}{}^mC_{ds}G_{ds}T_{ds}T_{ks}T_{ks}T_{ks}G_e$ | 62 | 1983 |
| 1341448 | 1705 | 1720 | 21520 | 21535 | TGGGACCAAGGATATA | $T_{ks}G_{ks}G_{ks}G_{ds}A_{ds}{}^mC_{ds}{}^mC_{ds}A_{ds}A_{ds}G_{ds}G_{ds}A_{ds}T_{ks}A_{ks}T_{ks}A_e$ | 55 | 1674 |
| 1341458 | 2194 | 2209 | 22009 | 22024 | TTAGTCTTGATGTAGT | $T_{ks}T_{ks}A_{ks}G_{ds}T_{ds}{}^mC_{ds}T_{ds}T_{ds}G_{ds}A_{ds}T_{ds}G_{ds}T_{ks}A_{ks}G_{ks}T_e$ | 61 | 1366 |
| 1341463 | 2350 | 2365 | 22165 | 22180 | ACTACAAGAGGTTATT | $A_{ks}{}^mC_{ks}T_{ks}A_{ds}{}^mC_{ds}A_{ds}A_{ds}G_{ds}A_{ds}G_{ds}G_{ds}T_{ds}T_{ks}A_{ks}T_{ks}T_e$ | 58 | 899 |
| 1341468 | N/A | N/A | 14204 | 14219 | CAGATTATTATGTGAT | ${}^mC_{ks}A_{ks}G_{ks}A_{ds}T_{ds}T_{ds}A_{ds}T_{ds}T_{ds}A_{ds}T_{ds}G_{ds}T_{ks}G_{ks}A_{ks}T_e$ | 38 | 2723 |
| 1341471 | 1075 | 1090 | 20890 | 20905 | GTGCCAAACCAATGTT | $G_{ks}T_{ks}G_{ks}{}^mC_{ds}{}^mC_{ds}A_{ds}A_{ds}A_{ds}{}^mC_{ds}{}^mC_{ds}A_{ds}A_{ds}T_{ks}G_{ks}T_{ks}T_e$ | 56 | 1042 |
| 1341473 | N/A | N/A | 11858 | 11873 | GATTAAGCAGAATTGT | $G_{ks}A_{ks}T_{ks}T_{ds}A_{ds}A_{ds}G_{ds}{}^mC_{ds}A_{ds}G_{ds}A_{ds}A_{ds}T_{ks}T_{ks}G_{ks}T_e$ | 28 | 1156 |
| 1341475 | N/A | N/A | 11543 | 11558 | TGACAATGGTTGCCAC | $T_{ks}G_{ks}A_{ks}{}^mC_{ds}A_{ds}A_{ds}T_{ds}G_{ds}G_{ds}T_{ds}T_{ds}G_{ds}{}^mC_{ks}{}^mC_{ks}A_{ks}{}^mC_e$ | 45 | 1233 |
| 1341485 | N/A | N/A | 16218 | 16233 | TATAGACTGGGTAGGA | $T_{ks}A_{ks}T_{ks}A_{ds}G_{ds}A_{ds}{}^mC_{ds}T_{ds}G_{ds}G_{ds}G_{ds}T_{ds}A_{ks}G_{ks}G_{ks}A_e$ | 55 | 2808 |
| 1341487 | N/A | N/A | 15491 | 15506 | TTAATGCCACCCTACC | $T_{ks}T_{ks}A_{ks}A_{ds}T_{ds}G_{ds}{}^mC_{ds}{}^mC_{ds}A_{ds}{}^mC_{ds}{}^mC_{ds}{}^mC_{ds}T_{ks}A_{ks}{}^mC_{ks}{}^mC_e$ | 20 | 2304 |
| 1341489 | N/A | N/A | 18092 | 18107 | TGATACACCAATGCAG | $T_{ks}G_{ks}A_{ks}T_{ds}A_{ds}{}^mC_{ds}A_{ds}{}^mC_{ds}{}^mC_{ds}A_{ds}A_{ds}T_{ds}G_{ks}{}^mC_{ks}A_{ks}G_e$ | 58 | 2370 |
| 1341490 | N/A | N/A | 19916 | 19931 | GGAGTGCATCTTAAGA | $G_{ks}G_{ks}A_{ks}G_{ds}T_{ds}G_{ds}{}^mC_{ds}A_{ds}T_{ds}{}^mC_{ds}T_{ds}T_{ds}A_{ks}A_{ks}G_{ks}A_e$ | 40 | 2810 |
| 1341491 | N/A | N/A | 19904 | 19919 | AAGATACCCAGGTTGC | $A_{ks}A_{ks}G_{ks}A_{ds}T_{ds}A_{ds}{}^mC_{ds}{}^mC_{ds}{}^mC_{ds}A_{ds}G_{ds}G_{ds}T_{ks}T_{ks}G_{ks}{}^mC_e$ | 69 | 2712 |
| 1341497 | N/A | N/A | 18690 | 18705 | CTTTGAGACTCTTGTT | ${}^mC_{ks}T_{ks}T_{ks}T_{ds}G_{ds}A_{ds}G_{ds}A_{ds}{}^mC_{ds}T_{ds}{}^mC_{ds}T_{ds}T_{ksks}T_{ks}T_e$ | 57 | 2583 |

TABLE 43 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % in-hibition | SEQ ID NO |
|---|---|---|---|---|---|---|---|---|
| 1341502 | N/A | N/A | 20187 | 20202 | TATTAGAAGTCAGCCC | $T_{ks}A_{ks}T_{ks}T_{ds}A_{ds}G_{ds}A_{ds}A_{ds}G_{ds}T_{ds}{}^mC_{ds}A_{ds}G_{ks}{}^mC_{ks}{}^mC_{ks}{}^mC_e$ | 32 | 164 |
| 1341504 | N/A | N/A | 20197 | 20212 | ACATTGCAGTTATTAG | $A_{ks}{}^mC_{ks}A_{ks}T_{ds}T_{ds}G_{ds}{}^mC_{ds}A_{ds}G_{ds}T_{ds}T_{ds}A_{ds}T_{ks}T_{ks}A_{ks}G_e$ | 52 | 2309 |
| 1341512 | N/A | N/A | 12794 | 12809 | AAGAGTCAGTATCCTC | $A_{ks}A_{ks}G_{ks}A_{ds}G_{ds}T_{ds}{}^mC_{ds}A_{ds}G_{ds}T_{ds}A_{ds}T_{ds}{}^mC_{ks}{}^mC_{ks}T_{ks}{}^mC_e$ | 67 | 2572 |
| 1341514 | N/A | N/A | 12496 | 12511 | AATTCACCTTGACTAA | $A_{ks}A_{ks}T_{ks}T_{ds}{}^mC_{ds}A_{ds}{}^mC_{ds}{}^mC_{ds}T_{ds}T_{ds}G_{ds}A_{ds}{}^mC_{ks}A_{ks}A_e$ | 16 | 2144 |
| 1341515 | N/A | N/A | 12804 | 12819 | CTCAGGCTGTAAGAGT | ${}^mC_{ks}T_{ks}{}^mC_{ks}A_{ds}G_{ds}G_{ds}{}^mC_{ds}T_{ds}G_{ds}T_{ds}A_{ds}A_{ds}G_{ks}A_{ks}G_{ks}T_e$ | 21 | 2240 |

TABLE 44

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % in-hibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}T_{ds}A_{ds}A_{ds}G_{ds}T_{ks}{}^mC_{ks}A_k$ | 79 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 83 | 1526 |
| 1340981 | 1495 | 1510 | 21310 | 21325 | TTGCACCGTTTTGGGC | $T_{ks}T_{ks}G_{ks}{}^mC_{ds}A_{ds}{}^mC_{ds}{}^mC_{ds}G_{ds}T_{ds}T_{ds}T_{ds}T_{ds}G_{ks}G_{ks}G_{ks}{}^mC_e$ | 50 | 1749 |
| 1340983 | 1499 | 1514 | 21314 | 21329 | AGAGTTGCACCGTTTT | $A_{ks}G_{ks}A_{ks}G_{ds}T_{ds}T_{ds}G_{ds}{}^mC_{ds}A_{ds}{}^mC_{ds}{}^mC_{ds}G_{ds}T_{ks}T_{ks}T_{ks}T_e$ | 78 | 34 |
| 1340991 | 810 | 825 | 15691 | 15706 | TATTGGTAAGTATTCC | $T_{ks}A_{ks}T_{ks}T_{ds}G_{ds}G_{ds}T_{ds}A_{ds}A_{ds}G_{ds}T_{ds}A_{ds}T_{ks}T_{ks}{}^mC_{ks}{}^mC_e$ | 48 | 1272 |
| 1340995 | 1620 | 1635 | 21435 | 21450 | AGTCGGTCACCTTTCA | $A_{ks}G_{ks}T_{ks}{}^mC_{ds}G_{ds}G_{ds}T_{ds}{}^mC_{ds}A_{ds}{}^mC_{ds}{}^mC_{ds}T_{ds}T_{ks}T_{ks}{}^mC_{ks}A_e$ | 75 | 272 |
| 1340998 | 1600 | 1615 | 21415 | 21430 | GTATCTTATAAGACTA | $G_{ks}T_{ks}A_{ks}T_{ds}{}^mC_{ds}T_{ds}T_{ds}A_{ds}T_{ds}A_{ds}A_{ds}G_{ds}A_{ks}{}^mC_{ks}T_{ks}A_e$ | 72 | 1595 |
| 1341000 | 1624 | 1639 | 21439 | 21454 | ATAGAGTCGGTCACCT | $A_{ks}T_{ks}A_{ks}G_{ds}A_{ds}G_{ds}T_{ds}{}^mC_{ds}G_{ds}G_{ds}T_{ds}{}^mC_{ds}A_{ks}{}^mC_{ks}{}^mC_{ks}T_e$ | 67 | 584 |
| 1341002 | 1712 | 1727 | 21527 | 21542 | ACATCTCTGGGACCAA | $A_{ks}{}^mC_{ks}A_{ks}T_{ds}{}^mC_{ds}T_{ds}{}^mC_{ds}T_{ds}G_{ds}G_{ds}G_{ds}A_{ds}{}^mC_{ks}{}^mC_{ks}A_{ks}A_e$ | 65 | 195 |
| 1341004 | 1628 | 1643 | 21443 | 21458 | TAAAATAGAGTCGGTC | $T_{ks}A_{ks}A_{ks}A_{ds}A_{ds}T_{ds}A_{ds}G_{ds}A_{ds}G_{ds}T_{ds}{}^mC_{ds}G_{ks}G_{ks}T_{ks}{}^mC_e$ | 74 | 895 |
| 1341011 | 1752 | 1767 | 21567 | 21582 | TCCTGTGTTAGCTTTA | $T_{ks}{}^mC_{ks}{}^mC_{ks}T_{ds}G_{ds}T_{ds}G_{ds}T_{ds}T_{ds}A_{ds}G_{ds}{}^mC_{ds}T_{ks}T_{ks}T_{ks}A_e$ | 75 | 1442 |
| 1341013 | 1721 | 1736 | 21536 | 21551 | ATTGTCTAAACATCTC | $A_{ks}T_{ks}T_{ks}G_{ds}T_{ds}{}^mC_{ds}T_{ds}A_{ds}A_{ds}A_{ds}{}^mC_{ds}A_{ds}T_{ks}{}^mC_{ks}T_{ks}{}^mC_e$ | 71 | 585 |
| 1341017 | 1019 | 1034 | 20834 | 20849 | TGCAGCATTGATTCGA | $T_{ks}G_{ks}{}^mC_{ks}A_{ds}G_{ds}{}^mC_{ds}A_{ds}T_{ds}T_{ds}G_{ds}A_{ds}T_{ds}T_{kss}{}^mC_{ks}G_{ks}A_e$ | 52 | 419 |
| 1341030 | 1784 | 1799 | 21599 | 21614 | GTTTCTTATGTAATAG | $G_{ks}T_{ks}T_{ks}T_{ds}{}^mC_{ds}T_{ds}T_{ds}A_{ds}T_{ds}G_{ds}T_{ds}A_{ds}A_{ks}T_{ks}A_{ks}G_e$ | 44 | 897 |
| 1341033 | 2189 | 2204 | 22004 | 22019 | CTTGATGTAGTGGGAG | ${}^mC_{ks}T_{ks}T_{ks}G_{ds}A_{ds}T_{ds}G_{ds}T_{ds}A_{ds}G_{ds}T_{ds}G_{ds}G_{ks}G_{ks}A_{ks}G_e$ | 62 | 976 |

TABLE 44 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341039 | 1780 | 1795 | 21595 | 21610 | CTTATGTAATAGCCAG | $^mC_{ks}T_{ks}T_{ds}A_{ds}T_{ds}G_{ds}T_{ds}A_{ds}T_{ds}A_{ds}G_{ds}{}^mC_{ks}{}^mC_{ks}A_{ks}G_e$ | 70 | 664 |
| 1341042 | N/A | N/A | 9334 | 9349 | CGATCCTATATACATC | $^mC_{ks}G_{ks}A_{ks}T_{ds}{}^mC_{ds}{}^mC_{ds}T_{ds}A_{ds}T_{ds}A_{ds}T_{ds}A_{ds}{}^mC_{ks}A_{ks}T_{ks}{}^mC_e$ | 29 | 2788 |
| 1341043 | 2252 | 2267 | 22067 | 22082 | AGAGGATAGTCCATGC | $A_{ks}G_{ks}A_{ks}G_{ds}G_{ds}A_{ds}T_{ds}A_{ds}G_{ds}T_{ds}{}^mC_{ds}{}^mC_{ds}A_{ks}T_{ks}G_{ks}{}^mC_e$ | 78 | 354 |
| 1341044 | 2353 | 2368 | 22168 | 22183 | ATAACTACAAGAGGTT | $A_{ks}T_{ks}A_{ks}A_{ds}{}^mC_{ds}T_{ds}A_{ds}{}^mC_{ds}A_{ds}A_{ds}G_{ds}A_{ds}G_{ks}G_{ks}T_{ks}T_e$ | 67 | 1133 |
| 1341053 | N/A | N/A | 9968 | 9983 | AGTAGTGTAAGCTGAG | $A_{ks}G_{ks}T_{ks}A_{ds}G_{ds}T_{ds}G_{ds}T_{ds}A_{ds}A_{ds}G_{ds}{}^mC_{ks}T_{ks}G_{ks}A_{ks}G_e$ | 71 | 2155 |
| 1341056 | N/A | N/A | 9516 | 9531 | ACACTAATATTGAGGC | $A_{ks}{}^mC_{ks}A_{ks}{}^mC_{ds}T_{ds}A_{ds}A_{ds}T_{ds}A_{ds}T_{ds}T_{ds}G_{ds}A_{ks}G_{ks}G_{ks}{}^mC_e$ | 68 | 1928 |
| 1341057 | N/A | N/A | 9603 | 9618 | CACATATGTGAAGAGC | $^mC_{ks}A_{ks}{}^mC_{ks}A_{ds}T_{ds}A_{ds}T_{ds}G_{ds}T_{ds}G_{ds}A_{ds}A_{ds}G_{ks}A_{ks}G_{ks}{}^mC_e$ | 74 | 760 |
| 1341060 | N/A | N/A | 12421 | 12436 | TGGTAACGGTGATCAA | $T_{ks}G_{ks}G_{ks}T_{ds}A_{ds}A_{ds}{}^mC_{ds}G_{ds}G_{ds}T_{ds}G_{ds}A_{ds}T_{ks}{}^mC_{ks}A_{ks}A_e$ | 35 | 67 |
| 1341068 | N/A | N/A | 11546 | 11561 | TCTTGACAATGGTTGC | $T_{ks}{}^mC_{ks}T_{ks}T_{ds}G_{ds}A_{ds}{}^mC_{ds}A_{ds}A_{ds}T_{ds}G_{ds}G_{ds}T_{ks}T_{ks}G_{ks}{}^mC_e$ | 77 | 2199 |
| 1341071 | N/A | N/A | 15494 | 15509 | GCATTAATGCCACCCT | $G_{ks}{}^mC_{ks}A_{ks}T_{ds}T_{ds}A_{ds}A_{ds}T_{ds}G_{ds}{}^mC_{ds}{}^mC_{ds}A_{ds}{}^mC_{ks}{}^mC_{ks}{}^mC_{ks}T_e$ | 51 | 1012 |
| 1341075 | 608 | 623 | N/A | N/A | ACAATATGGGATGAGG | $A_{ks}{}^mC_{ks}A_{ks}A_{ds}T_{ds}A_{ds}T_{ds}G_{ds}G_{ds}G_{ds}A_{ds}T_{ds}G_{ks}A_{ks}G_{ks}G_e$ | 76 | 1579 |
| 1341076 | N/A | N/A | 14914 | 14929 | ACATTAGCAAGCTAAG | $A_{ks}{}^mC_{ks}A_{ks}T_{ds}T_{ds}A_{ds}G_{ds}{}^mC_{ds}A_{ds}A_{ds}G_{ds}{}^mC_{ds}T_{ks}A_{ks}A_{ks}G_e$ | 41 | 2065 |
| 1341077 | 1080 | 1095 | 20895 | 20910 | TGCTAGTGCCAAACCA | $T_{ks}G_{ks}{}^mC_{ks}T_{ds}A_{ds}G_{ds}T_{ds}G_{ds}{}^mC_{ds}{}^mC_{ds}A_{ds}A_{ds}A_{ks}{}^mC_{ks}{}^mC_{ks}A_e$ | 73 | 1432 |
| 1341081 | N/A | N/A | 16223 | 16238 | CTTTTTATAGACTGGG | $^mC_{ks}T_{ks}T_{ks}T_{ds}T_{ds}T_{ds}A_{ds}T_{ds}A_{ds}G_{ds}A_{ds}{}^mC_{ds}T_{ks}G_{ks}G_{ks}G_e$ | 44 | 857 |
| 1341084 | N/A | N/A | 16384 | 16399 | AATCCCAACCAAACTT | $A_{ks}A_{ks}T_{ks}{}^mC_{ds}{}^mC_{ds}{}^mC_{ds}A_{ds}A_{ds}{}^mC_{ds}{}^mC_{ds}A_{ds}A_{ds}A_{ks}{}^mC_{ks}T_{ks}T_e$ | 13 | 2755 |
| 1341089 | N/A | N/A | 16129 | 16144 | TCCATAATAATAGCTC | $T_{ks}{}^mC_{ks}{}^mC_{ks}A_{ds}T_{ds}A_{ds}A_{ds}T_{ds}A_{ds}A_{ds}T_{ds}A_{ds}G_{ks}{}^mC_{ks}T_{ks}{}^mC_e$ | 66 | 546 |
| 1341092 | N/A | N/A | 18095 | 18110 | AATTGATACACCAATG | $A_{ks}A_{ks}T_{ks}T_{ds}G_{ds}A_{ds}T_{ds}A_{ds}{}^mC_{ds}A_{ds}{}^mC_{ds}{}^mC_{ds}A_{ks}A_{ks}T_{ks}G_e$ | 53 | 2525 |
| 1341096 | N/A | N/A | 17990 | 18005 | TTAGTATAGTTATCTT | $T_{ks}T_{ks}A_{ks}G_{ds}T_{ds}A_{ds}T_{ds}A_{ds}G_{ds}T_{ds}T_{ds}A_{ds}T_{ks}{}^mC_{ks}T_{ks}T_e$ | 45 | 2366 |
| 1341101 | N/A | N/A | 19909 | 19924 | ATCTTAAGATACCCAG | $A_{ks}T_{ks}{}^mC_{ks}T_{ds}T_{ds}A_{ds}A_{ds}G_{ds}A_{ds}T_{ds}A_{ds}{}^mC_{ds}{}^mC_{ks}{}^mC_{ks}A_{ks}G_e$ | 71 | 397 |
| 1341102 | N/A | N/A | 18693 | 18708 | AGACTTTGAGACTCTT | $A_{ks}G_{ks}A_{ks}{}^mC_{ds}T_{ds}T_{ds}T_{ds}G_{ds}A_{ds}G_{ds}A_{ds}{}^mC_{ds}T_{ks}{}^mC_{ks}T_{ks}T_e$ | 41 | 2804 |
| 1341103 | N/A | N/A | 19913 | 19928 | GTGCATCTTAAGATAC | $G_{ks}T_{ks}G_{ks}{}^mC_{ds}A_{ds}T_{ds}{}^mC_{ds}T_{ds}T_{ds}A_{ds}A_{ds}G_{ds}A_{ks}T_{ks}A_{ks}{}^mC_e$ | 29 | 2806 |
| 1341115 | N/A | N/A | 20190 | 20205 | AGTTATTAGAAGTCAG | $A_{ks}G_{ks}T_{ks}T_{ds}A_{ds}T_{ds}T_{ds}A_{ds}G_{ds}A_{ds}A_{ds}G_{ds}T_{ks}{}^mC_{ks}A_{ks}G_e$ | 56 | 2746 |
| 1341118 | N/A | N/A | 20114 | 20129 | GCATCAAGACATTCTA | $G_{ks}{}^mC_{ks}A_{ks}T_{ds}{}^mC_{ds}A_{ds}A_{ds}G_{ds}A_{ds}{}^mC_{ds}A_{ds}T_{ds}T_{ks}{}^mC_{ks}T_{ks}A_e$ | 84 | 1565 |
| 1341120 | 1084 | 1099 | 20899 | 20914 | CTGCTGCTAGTGCCAA | $^mC_{ks}T_{ks}G_{ks}{}^mC_{ds}T_{ds}G_{ds}{}^mC_{ds}T_{ds}A_{ds}G_{ds}T_{ds}G_{ds}{}^mC_{ks}{}^mC_{ks}A_{ks}A_e$ | 66 | 1743 |

TABLE 44 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341121 | N/A | N/A | 12499 | 12514 | AGAAATTCACCTTGAC | $A_{ks}G_{ks}A_{ds}A_{ds}T_{ds}T_{ds}{}^mC_{ds}A_{ds}{}^mC_{ds}{}^mC_{ds}T_{ds}T_{ks}G_{ks}A_{ks}{}^mC_e$ | 7 | 2284 |
| 1341126 | N/A | N/A | 20484 | 20499 | CTTCATAGTGGACTTC | ${}^mC_{ks}T_{ks}T_{ks}{}^mC_{ds}A_{ds}T_{ds}A_{ds}G_{ds}T_{ds}G_{ds}G_{ds}A_{ds}{}^mC_{ks}T_{ks}T_{ks}{}^mC_e$ | 57 | 711 |
| 1341131 | N/A | N/A | 14196 | 14211 | TATGTGATTGAGTTCT | $T_{ks}A_{ks}T_{ks}G_{ds}T_{ds}G_{ds}A_{ds}T_{ds}T_{ds}G_{ds}A_{ds}G_{ds}T_{ks}T_{ks}{}^mC_{ks}T_e$ | 43 | 2367 |
| 1341137 | N/A | N/A | 12797 | 12812 | TGTAAGAGTCAGTATC | $T_{ks}G_{ks}T_{ks}A_{ds}A_{ds}G_{ds}A_{ds}G_{ds}T_{ds}{}^mC_{ds}A_{ds}G_{ds}T_{ks}A_{ks}T_{ks}{}^mC_e$ | 46 | 2652 |
| 1341138 | N/A | N/A | 14172 | 14187 | TTGAATAGCAAGCCAA | $T_{ks}T_{ks}G_{ks}A_{ds}A_{ds}T_{ds}A_{ds}G_{ds}{}^mC_{ds}A_{ds}A_{ds}G_{ds}{}^mC_{ks}{}^mC_{ks}A_{ks}A_e$ | 33 | 1864 |
| 1341143 | 1261 | 1276 | 21076 | 21091 | AGGTAGCTTTTGTCCA | $A_{ks}G_{ks}G_{ks}T_{ds}A_{ds}G_{ds}{}^mC_{ds}T_{ds}T_{ds}T_{ds}T_{ds}G_{ds}T_{ks}{}^mC_{ks}{}^mC_{ks}A_e$ | 58 | 109 |
| 1341145 | 1256 | 1271 | 21071 | 21086 | GCTTTTGTCCACCTTT | $G_{ks}{}^mC_{ks}T_{ks}T_{ds}T_{ds}T_{ds}G_{ds}T_{ds}{}^mC_{ds}{}^mC_{ds}A_{ds}{}^mC_{ds}{}^mC_{ks}T_{ks}T_{ks}T_e$ | 81 | 1744 |
| 1341150 | 1318 | 1333 | 21133 | 21148 | TGAACAGTCTTAAACC | $T_{ks}G_{ks}A_{ks}A_{ds}{}^mC_{ds}A_{ds}G_{ds}T_{ds}{}^mC_{ds}T_{ds}T_{ds}A_{ds}A_{ks}A_{ks}{}^mC_{ks}{}^mC_e$ | 61 | 344 |
| 1341154 | 1314 | 1329 | 21129 | 21144 | CAGTCTTAAACCTTCC | ${}^mC_{ks}A_{ks}G_{ks}T_{ds}{}^mC_{ds}T_{ds}T_{ds}A_{ds}A_{ds}A_{ds}{}^mC_{ds}{}^mC_{ds}T_{ks}T_{ks}{}^mC_{ks}{}^mC_e$ | 74 | 30 |
| 1341160 | 698 | 713 | 12116 | 12131 | GAGACATGAGGTTTTG | $G_{ks}A_{ks}G_{ks}A_{ds}{}^mC_{ds}A_{ds}T_{ds}G_{ds}A_{ds}G_{ds}G_{ds}T_{ds}T_{ks}T_{ks}T_{ks}G_e$ | 61 | 725 |
| 1341166 | 1324 | 1339 | 21139 | 21154 | GCTACTTGAACAGTCT | $G_{ks}{}^mC_{ks}T_{ks}A_{ds}{}^mC_{ds}T_{ds}T_{ds}G_{ds}A_{ds}A_{ds}{}^mC_{ds}A_{ds}G_{ks}T_{ks}{}^mC_{ks}T_e$ | 60 | 811 |
| 1341184 | 1329 | 1344 | 21144 | 21159 | GGAATGCTACTTGAAC | $G_{ks}G_{ks}A_{ks}A_{ds}T_{ds}G_{ds}{}^mC_{ds}T_{ds}A_{ds}{}^mC_{ds}T_{ds}T_{ds}G_{ks}A_{ks}A_{ks}{}^mC_e$ | 68 | 1201 |
| 1341194 | 1337 | 1352 | 21152 | 21167 | TACAGATTGGAATGCT | $T_{ks}A_{ks}{}^mC_{ks}A_{ds}G_{ds}A_{ds}T_{ds}T_{ds}G_{ds}G_{ds}A_{ds}A_{ds}T_{ks}G_{ks}{}^mC_{ks}T_e$ | 66 | 1746 |
| 1341266 | 1349 | 1364 | 21164 | 21179 | CTGTGGCATGGCTACA | ${}^mC_{ks}T_{ks}G_{ks}T_{ds}G_{ds}G_{ds}{}^mC_{ds}A_{ds}T_{ds}G_{ds}G_{ds}{}^mC_{ds}T_{ks}A_{ks}{}^mC_{ks}A_e$ | 58 | 657 |
| 1341295 | 1354 | 1369 | 21169 | 21184 | ATATTCTGTGGCATGG | $A_{ks}T_{ks}A_{ks}T_{ds}T_{ds}{}^mC_{ds}T_{ds}G_{ds}T_{ds}G_{ds}G_{ds}{}^mC_{ds}A_{ks}T_{ks}G_{ks}G_e$ | 58 | 968 |
| 1341318 | 1358 | 1373 | 21173 | 21188 | GTTGATATTCTGTGGC | $G_{ks}T_{ks}T_{ks}G_{ds}A_{ds}T_{ds}A_{ds}T_{ds}T_{ds}{}^mC_{ds}T_{ds}G_{ds}T_{ks}G_{ks}G_{ks}{}^mC_e$ | 73 | 1280 |
| 1341392 | 1367 | 1382 | 21182 | 21197 | TGTGTTCTTGTTGATA | $T_{ks}G_{ks}T_{ks}G_{ds}T_{ds}T_{ds}{}^mC_{ds}T_{ds}T_{ds}G_{ds}T_{ds}T_{ds}G_{ks}A_{ks}T_{ks}A_e$ | 65 | 1591 |
| 1341400 | 796 | 811 | 15677 | 15692 | CCATCTATCAGACTTC | ${}^mC_{ks}{}^mC_{ks}A_{ks}T_{ds}{}^mC_{ds}T_{ds}A_{ds}T_{ds}{}^mC_{ds}A_{ds}G_{ds}A_{ds}{}^mC_{ks}T_{ks}T_{ks}{}^mC_e$ | 60 | 415 |
| 1341421 | 1420 | 1435 | 21235 | 21250 | GGTTGAGATAAAGCTG | $G_{ks}G_{ks}T_{ks}T_{ds}G_{ds}A_{ds}G_{ds}A_{ds}T_{ds}A_{ds}A_{ds}A_{ds}G_{ks}{}^mC_{ks}T_{ks}G_e$ | 67 | 1826 |
| 1341426 | 1393 | 1408 | 21208 | 21223 | TTGATCTCTTAGCTGT | $T_{ks}T_{ks}G_{ks}A_{ds}T_{ds}{}^mC_{ds}T_{ds}{}^mC_{ds}T_{ds}T_{ds}A_{ds}G_{ds}{}^mC_{ks}T_{ks}G_{ks}T_e$ | 64 | 658 |
| 1341431 | 1429 | 1444 | 21244 | 21259 | ATATGTCCAGGTTGAG | $A_{ks}T_{ks}A_{ks}T_{ds}G_{ds}T_{ds}{}^mC_{ds}{}^mC_{ds}A_{ds}G_{ds}G_{ds}T_{ds}T_{ks}G_{ks}A_{ks}G_e$ | 71 | 425 |
| 1341432 | 1491 | 1506 | 21306 | 21321 | ACCGTTTTGGGCTAAT | $A_{ks}{}^mC_{ks}{}^mC_{ks}G_{ds}T_{ds}T_{ds}T_{ds}T_{ds}G_{ds}G_{ds}G_{ds}{}^mC_{ds}T_{ks}A_{ks}A_{ks}T_e$ | 73 | 1438 |
| 1341435 | 1466 | 1481 | 21281 | 21296 | AGAGGCTAGGGAAATC | $A_{ks}G_{cs}A_{ks}G_{ds}G_{ds}{}^mC_{ds}T_{ds}A_{ds}G_{ds}G_{ds}G_{ds}A_{ds}A_{ks}A_{ks}T_{ks}{}^mC_e$ | 68 | 1048 |
| 1341441 | 1616 | 1631 | 21431 | 21446 | GGTCACCTTTCATAAT | $G_{ks}G_{ks}T_{ks}{}^mC_{ds}A_{ds}{}^mC_{ds}{}^mC_{ds}T_{ds}T_{ds}T_{ds}{}^mC_{ds}A_{ds}T_{ks}A_{ks}A_{ks}T_e$ | 49 | 1985 |

TABLE 44 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341449 | 1771 | 1786 | 21586 | 21601 | TAGCCAGTACAGTTCC | $T_{ks}A_{ks}G_{ks}{}^mC_{ds}{}^mC_{ds}A_{ds}G_{ds}T_{ds}A_{ds}{}^mC_{ds}A_{ds}G_{ds}T_{ks}T_{ks}{}^mC_{ks}{}^mC_e$ | 58 | 1987 |
| 1341451 | 1776 | 1791 | 21591 | 21606 | TGTAATAGCCAGTACA | $T_{ks}G_{ks}T_{ks}A_{ds}A_{ds}A_{ds}G_{ds}{}^mC_{ds}{}^mC_{ds}A_{ds}G_{ds}T_{ks}A_{ks}{}^mC_{ks}A_e$ | 34 | 352 |
| 1341456 | 1707 | 1722 | 21522 | 21537 | TCTGGGACCAAGGATA | $T_{ks}{}^mC_{ks}T_{ks}G_{ds}G_{ds}G_{ds}A_{ds}{}^mC_{ds}C_{ds}A_{ds}A_{ds}G_{ds}G_{ks}A_{ks}T_{ks}A_e$ | 57 | 1830 |
| 1341457 | 1716 | 1731 | 21531 | 21546 | CTAAACATCTCTGGGA | ${}^mC_{ks}T_{ks}A_{ks}A_{ds}A_{ds}{}^mC_{ds}A_{ds}T_{ds}{}^mC_{ds}T_{ds}{}^mC_{ds}T_{ds}G_{ks}G_{ks}G_{ks}A_e$ | 57 | 2259 |
| 1341466 | 2196 | 2211 | 22011 | 22026 | GATTAGTCTTGATGTA | $G_{ks}A_{ks}T_{ks}T_{ds}A_{ds}G_{ds}T_{ds}{}^mC_{ds}T_{ds}T_{ds}G_{ds}A_{ds}T_{ks}G_{ks}T_{ks}A_e$ | 48 | 1521 |
| 1341474 | N/A | N/A | 11578 | 11593 | GTTATTCTCTTGACAA | $G_{ks}T_{ks}T_{ks}A_{ds}T_{ds}T_{ds}{}^mC_{ds}T_{ds}{}^mC_{ds}T_{ds}T_{ds}G_{ds}A_{ds}{}^mC_{ks}A_{ks}A_e$ | 35 | 2575 |
| 1341482 | N/A | N/A | 16292 | 16307 | TTAGTTAGAATAGTCT | $T_{ks}T_{ks}A_{ks}G_{ds}T_{ds}T_{ds}A_{ds}G_{ds}A_{ds}A_{ds}T_{ds}A_{ds}G_{ks}T_{ks}{}^mC_{ks}T_e$ | 67 | 1714 |
| 1341488 | N/A | N/A | 19905 | 19920 | TAAGATACCCAGGTTG | $T_{ks}A_{ks}A_{ks}G_{ds}A_{ds}T_{ds}A_{ds}{}^mC_{ds}{}^mC_{ds}{}^mC_{ds}A_{ds}G_{ds}G_{ks}T_{ks}T_{ks}G_e$ | 58 | 2790 |
| 1341492 | 1076 | 1091 | 20891 | 20906 | AGTGCCAAACCAATGT | $A_{ks}G_{ks}T_{ks}G_{ds}{}^mC_{ds}{}^mC_{ds}A_{ds}A_{ds}A_{ds}{}^mC_{ds}{}^mC_{ds}A_{ds}A_{ks}T_{ks}G_{ks}T_e$ | 60 | 1120 |
| 1341495 | N/A | N/A | 17995 | 18010 | TGAAGTTAGTATAGTT | $T_{ks}G_{ks}A_{ks}A_{ds}G_{ds}T_{ds}T_{ds}A_{ds}G_{ds}T_{ds}A_{ds}T_{ds}A_{ks}G_{ks}T_{ks}T_e$ | 70 | 1405 |
| 1341498 | N/A | N/A | 19999 | 20014 | CAGTTTTCCTCATGAT | ${}^mC_{ks}A_{ks}G_{ks}T_{ds}T_{ds}T_{ds}T_{ds}{}^mC_{ds}{}^mC_{ds}T_{ds}{}^mC_{ds}A_{ds}T_{ks}G_{ks}A_{ks}T_e$ | 65 | 2331 |
| 1341500 | N/A | N/A | 20378 | 20393 | CACAAGTAAGGTAAAG | ${}^mC_{ks}A_{ks}{}^mC_{ks}A_{ds}A_{ds}G_{ds}T_{ds}A_{ds}A_{ds}G_{ds}G_{ds}T_{ds}A_{ks}A_{ks}A_{ks}G_e$ | 55 | 2448 |
| 1341503 | N/A | N/A | 20388 | 20403 | CTATAGTAATCACAAG | ${}^mC_{ks}T_{ks}A_{ks}T_{ds}A_{ds}G_{ds}T_{ds}A_{ds}A_{ds}T_{ds}{}^mC_{ds}A_{ds}{}^mC_{ks}A_{ks}A_{ks}G_e$ | 53 | 1644 |
| 1341510 | 1091 | 1106 | 20906 | 20921 | CGTTTGACTGCTGCTA | ${}^mC_{ks}G_{ks}T_{ks}T_{ds}T_{ds}G_{ds}A_{ds}{}^mC_{ds}T_{ds}G_{ds}{}^mC_{ds}T_{ds}G_{ks}{}^mC_{ks}T_{ks}A_e$ | 75 | 264 |
| 1341513 | N/A | N/A | 13959 | 13974 | GTCTACCTCTAAGTTA | $G_{ks}T_{ks}{}^mC_{ks}T_{ds}A_{ds}{}^mC_{ds}{}^mC_{ds}T_{ds}{}^mC_{ds}T_{ds}A_{ds}A_{ds}G_{ks}T_{ks}T_{ks}A_e$ | 41 | 2363 |
| 1341516 | N/A | N/A | 13949 | 13964 | AAGTTAGCCCCCAGGA | $A_{ks}A_{ks}G_{ks}T_{ds}T_{ds}A_{ds}G_{ds}{}^mC_{ds}{}^mC_{ds}{}^mC_{ds}{}^mC_{ds}{}^mC_{ds}A_{ks}G_{ks}G_{ks}A_e$ | 23 | 2811 |

TABLE 45

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^mC_{ks}A_k$ | 79 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 80 | 1526 |
| 1340980 | 610 | 625 | N/A | N/A | GAACAATATGGGATGA | $G_{ks}A_{ks}A_{ks}{}^mC_{ds}A_{ds}A_{ds}T_{ds}A_{ds}T_{ds}G_{ds}G_{ds}G_{ds}A_{ks}T_{ks}G_{ks}A_e$ | 52 | 1735 |
| 1340985 | 1492 | 1507 | 21307 | 21322 | CACCGTTTTGGGCTAA | ${}^mC_{ks}A_{ks}{}^mC_{ks}{}^mC_{ds}G_{ds}T_{ds}T_{ds}T_{ds}T_{ds}G_{ds}G_{ds}G_{ds}{}^mC_{ks}T_{ks}A_{ks}A_e$ | 71 | 1516 |

TABLE 45 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1340986 | 1501 | 1516 | 21316 | 21331 | ATAGAGTTGCACCGTT | $A_{ks}A_{ks}G_{ds}A_{ds}G_{ds}T_{ds}T_{ds}G_{ds}G_{ds}G_{ds}G_{ds}{}^mC_{ks}T_{ks}A_{ks}A_e$ | 71 | 192 |
| 1340989 | 812 | 827 | 15693 | 15708 | CTTATTGGTAAGTATT | ${}^mC_{ks}T_{ks}T_{ks}A_{ds}T_{ds}T_{ds}G_{ds}G_{ds}T_{ds}A_{ds}A_{ds}G_{ks}A_{ks}T_{ks}T_e$ | 24 | 1350 |
| 1340992 | 1621 | 1636 | 21436 | 21451 | GAGTCGGTCACCTTTC | $G_{ks}A_{ks}G_{ks}T_{ds}{}^mC_{ds}G_{ds}G_{ds}T_{ds}{}^mC_{ds}A_{ds}{}^mC_{ds}{}^mC_{ds}T_{ks}T_{ks}T_{ks}{}^mC_e$ | 74 | 350 |
| 1340996 | 1602 | 1617 | 21417 | 21432 | ATGTATCTTATAAGAC | $A_{ks}T_{ks}G_{ks}T_{ds}A_{ds}{}^mC_{ds}T_{ds}T_{ds}A_{ds}T_{ds}A_{ds}A_{ds}G_{ks}A_{ks}{}^mC_e$ | 24 | 1751 |
| 1340999 | 1617 | 1632 | 21432 | 21447 | CGGTCACCTTTCATAA | ${}^mC_{ks}G_{ks}G_{ks}T_{ds}{}^mC_{ds}A_{ds}{}^mC_{ds}{}^mC_{ds}T_{ds}T_{ds}T_{ds}{}^mC_{ds}A_{ks}T_{ks}A_{ks}A_e$ | 67 | 36 |
| 1341003 | 1625 | 1640 | 21440 | 21455 | AATAGAGTCGGTCACC | $A_{ks}A_{ks}T_{ks}A_{ds}G_{ds}A_{ds}G_{ds}T_{ds}{}^mC_{ds}G_{ds}G_{ds}T_{ds}{}^mC_{ks}A_{ks}{}^mC_{ks}{}^mC_e$ | 58 | 662 |
| 1341007 | 1629 | 1644 | 21444 | 21459 | TTAAAATAGAGTCGGT | $T_{ks}T_{ks}A_{ks}A_{ds}A_{ds}A_{ds}T_{ds}A_{ds}G_{ds}A_{ds}G_{ds}T_{ds}{}^mC_{ks}G_{ks}G_{ks}T_e$ | 71 | 973 |
| 1341010 | 1708 | 1723 | 21523 | 21538 | CTCTGGGACCAAGGAT | ${}^mC_{ks}T_{ks}{}^mC_{ks}T_{ds}G_{ds}G_{ds}G_{ds}A_{ds}{}^mC_{ds}{}^mC_{ds}A_{ds}A_{ds}G_{ks}G_{ks}A_{ks}T_e$ | 62 | 1908 |
| 1341015 | 1713 | 1728 | 21528 | 21543 | AACATCTCTGGGACCA | $A_{ks}A_{ks}{}^mC_{ks}A_{ds}T_{ds}{}^mC_{ds}T_{ds}{}^mC_{ds}T_{ds}G_{ds}G_{ds}G_{ds}A_{ks}{}^mC_{ks}{}^mC_{ks}A_e$ | 61 | 273 |
| 1341021 | 1773 | 1788 | 21588 | 21603 | AATAGCCAGTACAGTT | $A_{ks}A_{ks}T_{ks}A_{ds}G_{ds}{}^mC_{ds}{}^mC_{ds}A_{ds}G_{ds}T_{ds}A_{ds}{}^mC_{ds}A_{ks}G_{ks}T_{ks}T_e$ | 61 | 118 |
| 1341022 | 1781 | 1796 | 21596 | 21611 | TCTTATGTAATAGCCA | $T_{ks}{}^mC_{ks}T_{ks}T_{ds}A_{ds}T_{ds}G_{ds}T_{ds}A_{ds}A_{ds}T_{ds}A_{ds}G_{ks}{}^mC_{ks}{}^mC_{ks}A_e$ | 76 | 742 |
| 1341023 | 1766 | 1781 | 21581 | 21596 | AGTACAGTTCCTTTTC | $A_{ks}G_{ks}T_{ks}A_{sds}{}^mC_{dss}A_{ds}G_{ds}T_{ds}T_{ds}{}^mC_{ds}{}^mC_{ds}T_{ds}T_{ks}T_{ks}T_{ks}{}^mC_e$ | 59 | 1597 |
| 1341024 | 1777 | 1792 | 21592 | 21607 | ATGTAATAGCCAGTAC | $A_{ks}T_{ks}G_{ks}T_{ds}A_{ds}A_{ds}T_{ds}A_{ds}G_{ds}{}^mC_{ds}{}^mC_{ds}A_{ds}G_{ks}T_{ks}A_{ks}{}^mC_e$ | 63 | 430 |
| 1341034 | 2191 | 2206 | 22006 | 22021 | GTCTTGATGTAGTGGG | $G_{ks}T_{ks}{}^mC_{ks}T_{ds}T_{ds}G_{ds}A_{ds}T_{ds}G_{ds}T_{ds}A_{ds}G_{ds}T_{ks}G_{ks}G_{ks}G_e$ | 70 | 1132 |
| 1341040 | 1081 | 1096 | 20896 | 20911 | CTGCTAGTGCCAAACC | ${}^mC_{ks}T_{ks}G_{ks}{}^mC_{ds}T_{ds}A_{ds}G_{ds}T_{ds}G_{ds}{}^mC_{ds}{}^mC_{ds}A_{ds}A_{ks}A_{ks}{}^mC_{ks}{}^mC_e$ | 67 | 1510 |
| 1341045 | 2254 | 2269 | 22069 | 22084 | CAAGAGGATAGTCCAT | ${}^mC_{ks}A_{ks}A_{ks}G_{ds}A_{ds}G_{ds}G_{ds}A_{ds}T_{ds}A_{ds}G_{ds}T_{ds}{}^mC_{ks}{}^mC_{ks}A_{ks}T_e$ | 64 | 510 |
| 1341048 | 2245 | 2260 | 22060 | 22075 | AGTCCATGCAAAAGCA | $A_{ks}G_{ks}T_{ks}{}^mC_{ds}{}^mC_{ds}A_{ds}T_{ds}G_{ds}{}^mC_{ds}A_{ds}A_{ds}A_{ds}A_{ks}G_{ks}{}^mC_{ks}A_e$ | 80 | 120 |
| 1341049 | 2355 | 2370 | 22170 | 22185 | TTATAACTACAAGAGG | $T_{ks}T_{ks}A_{ks}T_{ds}A_{ds}A_{ds}{}^mC_{ds}T_{ds}A_{ds}{}^mC_{ds}A_{ds}A_{ds}G_{ks}A_{ks}G_{ks}G_e$ | 43 | 1289 |
| 1341051 | 1077 | 1092 | 20892 | 20907 | TAGTGCCAAACCAATG | $T_{ks}A_{ks}G_{ks}T_{ds}G_{ds}{}^mC_{ds}{}^mC_{ds}A_{ds}A_{ds}A_{ds}{}^mC_{ds}{}^mC_{ds}A_{ks}A_{ks}T_{ks}G_e$ | 61 | 1198 |
| 1341059 | N/A | N/A | 9518 | 9533 | CTACACTAATATTGAG | ${}^mC_{ks}T_{ks}A_{ks}{}^mC_{ds}A_{ds}{}^mC_{ds}T_{ds}A_{ds}A_{ds}T_{ds}A_{ds}T_{ds}T_{ks}G_{ks}A_{ks}G_e$ | 10 | 59 |
| 1341065 | N/A | N/A | 11853 | 11868 | AGCAGAATTGTGAACG | $A_{ks}G_{ks}{}^mC_{ks}A_{ds}G_{ds}A_{ds}A_{ds}T_{ds}T_{ds}G_{ds}T_{ds}G_{ds}A_{ks}A_{ks}{}^mC_{ks}G_e$ | 56 | 844 |
| 1341066 | N/A | N/A | 12423 | 12438 | GGTGGTAACGGTGATC | $G_{ks}G_{ks}T_{ks}G_{ds}G_{ds}T_{ds}A_{ds}A_{ds}{}^mC_{ds}G_{ds}G_{ds}T_{ds}G_{ks}A_{ks}T_{ks}{}^mC_e$ | 47 | 2591 |
| 1341072 | N/A | N/A | 15496 | 15511 | CTGCATTAATGCCACC | ${}^mC_{ks}T_{ks}G_{ks}{}^mC_{ds}A_{ds}T_{ds}T_{ds}A_{ds}A_{ds}T_{ds}G_{ds}{}^mC_{ds}{}^mC_{ks}A_{ks}{}^mC_{ks}{}^mC_e$ | 40 | 1168 |
| 1341074 | N/A | N/A | 14197 | 14212 | TTATGTGATTGAGTTC | $T_{ks}T_{ks}A_{ks}T_{ds}G_{ds}T_{ds}G_{ds}A_{ds}T_{ds}T_{ds}G_{ds}A_{ds}G_{ks}T_{ks}T_{ks}{}^mC_e$ | 30 | 2431 |

TABLE 45 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341078 | N/A | N/A | 14916 | 14931 | ATACATTAGCAAGCTA | $A_{ks}T_{ks}A_{ks}{}^mC_{ds}A_{ds}T_{ds}T_{ds}A_{ds}G_{ds}{}^mC_{ds}A_{ds}A_{ds}G_{ks}{}^mC_{ks}T_{ks}A_e$ | 48 | 309 |
| 1341086 | N/A | N/A | 16131 | 16146 | GCTCCATAATAATAGC | $G_{ks}{}^mC_{ks}T_{ks}{}^mC_{ds}{}^mC_{ds}A_{ds}T_{ds}A_{ds}A_{ds}T_{ds}A_{ds}A_{ds}T_{ds}A_{ks}G_{ks}{}^mC_e$ | 8 | 2665 |
| 1341091 | N/A | N/A | 17991 | 18006 | GTTAGTATAGTTATCT | $G_{ks}T_{ks}T_{ks}A_{ds}G_{ds}T_{ds}A_{ds}T_{ds}A_{ds}G_{ds}T_{ds}T_{ds}A_{ks}T_{ks}{}^mC_{ks}T_e$ | 71 | 1171 |
| 1341094 | N/A | N/A | 18097 | 18112 | GAAATTGATACACCAA | $G_{ks}A_{ks}A_{ks}A_{ds}T_{ds}T_{ds}G_{ds}A_{ds}T_{ds}A_{ds}{}^mC_{ds}A_{ds}{}^mC_{ks}{}^mC_{ks}A_{ks}A_e$ | 64 | 315 |
| 1341104 | N/A | N/A | 19910 | 19925 | CATCTTAAGATACCCA | ${}^mC_{ks}A_{ks}T_{ks}{}^mC_{ds}T_{ds}T_{ds}A_{ds}A_{ds}G_{ds}A_{ds}T_{ds}A_{ds}{}^mC_{ks}{}^mC_{ks}{}^mC_{ks}A_e$ | 76 | 475 |
| 1341106 | N/A | N/A | 18695 | 18710 | AAAGACTTTGAGACTC | $A_{ks}A_{ks}A_{ks}G_{ds}A_{ds}{}^mC_{ds}T_{ds}T_{ds}T_{ds}G_{ds}A_{ds}G_{ds}A_{ks}{}^mC_{ks}T_{ks}{}^mC_e$ | 67 | 1250 |
| 1341109 | 1085 | 1100 | 20900 | 20915 | ACTGCTGCTAGTGCCA | $A_{ks}{}^mC_{ks}T_{ks}G_{ds}{}^mC_{ds}T_{ds}G_{ds}{}^mC_{ds}T_{ds}A_{ds}G_{ds}T_{ds}G_{ks}{}^mC_{ks}{}^mC_{ks}A_e$ | 57 | 1821 |
| 1341111 | N/A | N/A | 20116 | 20131 | CAGCATCAAGACATTC | ${}^mC_{ks}A_{ks}G_{ks}{}^mC_{ds}A_{ds}T_{ds}{}^mC_{ds}A_{ds}A_{ds}G_{ds}A_{ds}{}^mC_{ds}A_{ks}T_{ks}T_{ks}{}^mC_e$ | 70 | 2191 |
| 1341112 | N/A | N/A | 20381 | 20396 | AATCACAAGTAAGGTA | $A_{ks}A_{ks}T_{ks}{}^mC_{ds}A_{ds}{}^mC_{ds}A_{ds}A_{ds}G_{ds}T_{ds}A_{ds}A_{ds}G_{ks}G_{ks}T_{ks}A_e$ | 63 | 1333 |
| 1341117 | N/A | N/A | 20192 | 20207 | GCAGTTATTAGAAGTC | $G_{ks}{}^mC_{ks}A_{ks}G_{ds}T_{ds}T_{ds}A_{ds}T_{ds}T_{ds}A_{ds}G_{ds}A_{ds}A_{ks}G_{ks}T_{ks}{}^mC_e$ | 67 | 398 |
| 1341124 | N/A | N/A | 12501 | 12516 | GCAGAAATTCACCTTG | $G_{ks}{}^mC_{ks}A_{ks}G_{ds}A_{ds}A_{ds}A_{ds}T_{ds}T_{ds}{}^mC_{ds}A_{ds}{}^mC_{ds}{}^mC_{ks}T_{ks}T_{ks}G_e$ | 62 | 1002 |
| 1341128 | N/A | N/A | 20486 | 20501 | AACTTCATAGTGGACT | $A_{ks}A_{ks}{}^mC_{ks}T_{ds}T_{ds}{}^mC_{ds}A_{ds}T_{ds}A_{ds}G_{ds}T_{ds}G_{ds}G_{ks}A_{ks}{}^mC_{ks}T_e$ | 70 | 2555 |
| 1341129 | N/A | N/A | 20422 | 20437 | ACAGTAAAATTATGCC | $A_{ks}{}^mC_{ks}A_{ks}G_{ds}T_{ds}A_{ds}A_{ds}A_{ds}A_{ds}T_{ds}T_{ds}A_{ds}T_{ks}G_{ks}{}^mC_{ks}{}^mC_e$ | 62 | 477 |
| 1341135 | N/A | N/A | 13952 | 13967 | TCTAAGTTAGCCCCCA | $T_{ks}{}^mC_{ks}T_{ks}A_{ds}A_{ds}G_{ds}T_{ds}T_{ds}A_{ds}G_{ds}{}^mC_{ds}{}^mC_{ds}{}^mC_{ks}{}^mC_{ks}{}^mC_{ks}A_e$ | 0 | 928 |
| 1341139 | N/A | N/A | 12799 | 12814 | GCTGTAAGAGTCAGTA | $G_{ks}{}^mC_{ks}T_{ks}G_{ds}T_{ds}A_{ds}A_{ds}G_{ds}A_{ds}G_{ds}T_{ds}{}^mC_{ds}A_{ks}G_{ks}T_{ks}A_e$ | 52 | 693 |
| 1341140 | 1180 | 1195 | 20995 | 21010 | GTTTTTAAGAGGCATG | $G_{ks}T_{ks}T_{ks}T_{ds}T_{ds}T_{ds}A_{ds}A_{ds}G_{ds}A_{ds}G_{ds}G_{ds}{}^mC_{ks}A_{ks}T_{ks}G_e$ | 78 | 1199 |
| 1341142 | 1257 | 1272 | 21072 | 21087 | AGCTTTTGTCCACCTT | $A_{ks}G_{ks}{}^mC_{ks}T_{ds}T_{ds}T_{ds}T_{ds}G_{ds}T_{ds}{}^mC_{ds}{}^mC_{ds}A_{ks}{}^mC_{ks}{}^mC_{ks}T_{ks}T_{ks}{}^mC_e$ | 69 | 1822 |
| 1341151 | 1315 | 1330 | 21130 | 21145 | ACAGTCTTAAACCTTC | $A_{ks}{}^mC_{ks}A_{ks}G_{ds}T_{ds}{}^mC_{ds}T_{ds}T_{ds}A_{ds}A_{ds}A_{ds}{}^mC_{ds}{}^mC_{ks}T_{ks}T_{ks}{}^mC_e$ | 73 | 110 |
| 1341153 | 1325 | 1340 | 21140 | 21155 | TGCTACTTGAACAGTC | $T_{ks}C_{ks}{}^mC_{ks}T_{ds}A_{ds}{}^mC_{ds}T_{ds}T_{ds}G_{ds}A_{ds}A_{ds}{}^mC_{ds}A_{ks}G_{ks}T_{ks}{}^mC_e$ | 68 | 889 |
| 1341156 | 1311 | 1326 | 21126 | 21141 | TCTTAAACCTTCCCTG | $T_{ks}{}^mC_{ks}T_{ks}T_{ds}A_{ds}A_{ds}A_{ds}{}^mC_{ds}{}^mC_{ds}T_{ds}T_{ds}{}^mC_{ds}{}^mC_{ks}{}^mC_{ks}T_{ks}G_e$ | 38 | 2160 |
| 1341158 | 700 | 715 | 12118 | 12133 | CAGAGACATGAGGTTT | ${}^mC_{ks}A_{ks}G_{ks}A_{ds}G_{ds}A_{ds}{}^mC_{ds}A_{ds}T_{ds}G_{ds}A_{ds}G_{ds}G_{ks}T_{ks}T_{ks}T_e$ | 45 | 2319 |
| 1341167 | 1321 | 1336 | 21136 | 21151 | ACTTGAACAGTCTTAA | $A_{ks}{}^mC_{ks}T_{ks}T_{ds}G_{ds}A_{ds}A_{ds}{}^mC_{ds}A_{ds}G_{ds}T_{ds}{}^mC_{ds}T_{ks}T_{ks}A_{ks}A_e$ | 60 | 578 |
| 1341173 | 1331 | 1346 | 21146 | 21161 | TTGGAATGCTACTTGA | $T_{ks}T_{ks}G_{ks}G_{ds}A_{ds}A_{ds}T_{ds}G_{ds}{}^mC_{ds}T_{ds}A_{ds}{}^mC_{ds}T_{ks}T_{ks}G_{ks}A_e$ | 56 | 1279 |
| 1341232 | 1340 | 1355 | 21155 | 21170 | GGCTACAGATTGGAAT | $G_{ks}G_{ks}{}^mC_{ks}T_{ds}A_{ds}{}^mC_{ds}A_{ds}G_{ds}A_{ds}T_{ds}T_{ds}G_{ds}G_{ks}A_{ks}A_{ks}T_e$ | 28 | 1980 |

TABLE 45 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341255 | 1351 | 1366 | 21166 | 21181 | TTCTGTGGCATGGCTA | $T_{ks}T_{ks}{}^mC_{ks}T_{ds}G_{ds}T_{ds}G_{ds}G_{ds}{}^mC_{ds}A_{ds}T_{ds}G_{ds}G_{ks}{}^mC_{ks}T_{ks}A_e$ | 59 | 812 |
| 1341271 | 1355 | 1370 | 21170 | 21185 | GATATTCTGTGGCATG | $G_{ks}A_{ks}T_{ks}A_{ds}T_{ds}T_{ds}{}^mC_{ds}T_{ds}G_{ds}T_{ds}G_{ds}G_{ds}{}^mC_{ks}A_{ks}T_{ks}G_e$ | 71 | 1046 |
| 1341321 | 1359 | 1374 | 21174 | 21189 | TGTTGATATTCTGTGG | $T_{ks}G_{ks}T_{ks}T_{ds}G_{ds}A_{ds}T_{ds}A_{ds}T_{ds}T_{ds}{}^mC_{ds}T_{ds}G_{ks}T_{ks}G_{ks}G_e$ | 64 | 1358 |
| 1341323 | 798 | 813 | 15679 | 15694 | TTCCATCTATCAGACT | $T_{ks}T_{ks}{}^mC_{ks}{}^mC_{ds}A_{ds}T_{ds}{}^mC_{ds}T_{ds}A_{ds}T_{ds}{}^mC_{ds}A_{ds}G_{ks}A_{ks}{}^mC_{ks}T_e$ | 43 | 571 |
| 1341427 | 1395 | 1410 | 21210 | 21225 | ACTTGATCTCTTAGCT | $A_{ks}{}^mC_{ks}T_{ks}T_{ds}G_{ds}A_{ds}T_{ds}{}^mC_{ds}T_{ds}{}^mC_{ds}T_{ds}T_{ds}A_{ks}G_{ks}{}^mC_{ks}T_e$ | 59 | 813 |
| 1341428 | 1387 | 1402 | 21202 | 21217 | TCTTAGCTGTGCACTC | $T_{ks}{}^mC_{ks}T_{ks}T_{ds}A_{ds}G_{ds}{}^mC_{ds}T_{ds}G_{ds}T_{ds}G_{ds}{}^mC_{ds}A_{ks}{}^mC_{ks}T_{ks}{}^mC_e$ | 52 | 190 |
| 1341436 | 1421 | 1436 | 21236 | 21251 | AGGTTGAGATAAAGCT | $A_{ks}G_{ks}G_{ks}T_{ds}T_{ds}G_{ds}A_{ds}G_{ds}A_{ds}T_{ds}A_{ds}A_{ds}A_{ks}G_{ks}{}^mC_{ks}T_e$ | 71 | 1904 |
| 1341437 | 1431 | 1446 | 21246 | 21261 | AAATATGTCCAGGTTG | $A_{ks}A_{ks}A_{ks}T_{ds}A_{ds}T_{ds}G_{ds}T_{ds}{}^mC_{ds}{}^mC_{ds}A_{ds}G_{ds}G_{ks}T_{ks}T_{ks}G_e$ | 74 | 581 |
| 1341446 | 1488 | 1503 | 21303 | 21318 | GTTTTGGGCTAATGAA | $G_{ks}T_{ks}T_{ks}T_{ds}T_{ds}G_{ds}G_{ds}G_{ds}{}^mC_{ds}T_{ds}A_{ds}A_{ds}T_{ks}G_{ks}A_{ks}A_e$ | 47 | 1204 |
| 1341447 | 1496 | 1511 | 21311 | 21326 | GTTGCACCGTTTTGGG | $G_{ks}T_{k}j_{ks}G_{ds}{}^mC_{ds}A_{ds}{}^mC_{ds}{}^mC_{ds}G_{ds}T_{ds}T_{ds}T_{ds}T_{ks}G_{ks}G_{ks}G_e$ | 45 | 1827 |
| 1341450 | 1726 | 1741 | 21541 | 21556 | CTAAAATTGTCTAAAC | ${}^mC_{ks}T_{ks}A_{ks}A_{ds}A_{ds}A_{ds}T_{ds}T_{ds}G_{ds}T_{ds}{}^mC_{ds}T_{ds}A_{ks}A_{ks}A_{ks}{}^mC_e$ | 7 | 2590 |
| 1341454 | 1022 | 1037 | 20837 | 20852 | CTTTGCAGCATTGATT | ${}^mC_{ks}T_{ks}TIc_{ds}T_{ds}G_{ds}{}^mC_{ds}A_{ds}G_{ds}{}^mC_{ds}A_{ds}T_{ds}T_{ds}G_{ks}A_{ks}T_{ks}T_e$ | 56 | 2463 |
| 1341455 | 1717 | 1732 | 21532 | 21547 | TCTAAACATCTCTGGG | $T_{ks}{}^mC_{ks}T_{ks}A_{ds}A_{ds}A_{ds}{}^mC_{ds}A_{ds}T_{ds}{}^mC_{ds}T_{ds}{}^mC_{ds}T_{ks}G_{ks}G_{ks}G_e$ | 42 | 2287 |
| 1341460 | N/A | N/A | 9337 | 9352 | CCTCGATCCTATATAC | ${}^mC_{ks}{}^mC_{ks}T_{ks}{}^mC_{ds}G_{ds}A_{ds}T_{ds}{}^mC_{ds}{}^mC_{ds}T_{ds}A_{ds}T_{ds}A_{ks}T_{ks}A_{ks}{}^mC_e$ | 11 | 2812 |
| 1341467 | 2184 | 2199 | 21999 | 22014 | TGTAGTGGGAGTCGGA | $T_{ks}G_{ks}T_{ks}A_{ds}G_{ds}T_{ds}G_{ds}G_{ds}G_{ds}A_{ds}G_{ds}T_{ds}{}^mC_{ks}G_{ks}G_{ks}A_e$ | 53 | 587 |
| 1341469 | N/A | N/A | 9971 | 9986 | TTGAGTAGTGTAAGCT | $T_{ks}T_{ks}G_{ks}A_{ds}G_{ds}T_{ds}A_{ds}G_{ds}T_{ds}G_{ds}T_{ds}A_{ds}A_{ks}G_{ks}{}^mC_{ks}T_e$ | 40 | 2346 |
| 1341476 | N/A | N/A | 11568 | 11583 | TGACAATGGTTGATAG | $T_{ks}G_{ks}A_{ks}{}^mC_{ds}A_{ds}A_{ds}T_{ds}G_{ds}G_{ds}T_{ds}T_{ds}G_{ds}A_{ks}T_{ks}A_{ks}G_e$ | 38 | 1700 |
| 1341477 | N/A | N/A | 9961 | 9976 | TAAGCTGAGAGTTCTA | $T_{ks}A_{ks}A_{ks}G_{ds}{}^mC_{ds}T_{ds}G_{ds}A_{ds}G_{ds}A_{ds}G_{ds}T_{ds}T_{ks}{}^mC_{ks}T_{ks}A_e$ | 48 | 2499 |
| 1341479 | N/A | N/A | 17986 | 18001 | TATAGTTATCTTCTCA | $T_{ks}A_{ks}T_{ks}A_{ds}G_{ds}T_{ds}T_{ds}A_{ds}T_{ds}{}^mC_{ds}T_{ds}T_{ds}{}^mC_{ks}T_{ks}{}^mC_{ks}A_e$ | 59 | 2295 |
| 1341481 | N/A | N/A | 17996 | 18011 | ATGAAGTTAGTATAGT | $A_{ks}T_{ks}G_{ks}A_{ds}A_{ds}G_{ds}T_{ds}T_{ds}A_{ds}G_{ds}T_{ds}A_{ds}T_{ks}A_{ks}G_{ks}T_e$ | 61 | 1483 |
| 1341483 | N/A | N/A | 16282 | 16297 | TAGTCTTCAGCAAAGT | $T_{ks}A_{ks}Gr_{ks}T_{ds}{}^mC_{ds}T_{ds}T_{ds}{}^mC_{ds}A_{ds}G_{ds}{}^mC_{ds}A_{ds}A_{ks}A_{ks}G_{ks}T_e$ | 36 | 2632 |
| 1341484 | N/A | N/A | 16377 | 16392 | ACCAAACTTCCAGCAG | $A_{ks}{}^mC_{ks}{}^mC_{ks}A_{ds}A_{ds}A_{ds}{}^mC_{ds}T_{ds}T_{ds}{}^mC_{ds}{}^mC_{ds}A_{ds}G_{ks}{}^mC_{ks}A_{ks}G_e$ | 36 | 1948 |
| 1341493 | N/A | N/A | 19914 | 19929 | AGTGCATCTTAAGATA | $A_{ks}G_{ks}T_{ks}G_{ds}{}^mC_{ds}A_{ds}T_{ds}{}^mC_{ds}T_{ds}T_{ds}A_{ds}A_{ds}G_{ks}A_{ks}T_{ks}A_e$ | 12 | 2130 |
| 1341505 | N/A | N/A | 19906 | 19921 | TTAAGATACCCAGGTT | $T_{ks}T_{ks}A_{ks}A_{ds}G_{ds}A_{ds}T_{ds}A_{ds}{}^mC_{ds}{}^mC_{ds}{}^mC_{ds}A_{ds}G_{ks}G_{ks}T_{ks}T_e$ | 51 | 163 |

TABLE 45 -continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341507 | N/A | N/A | 20009 | 20024 | AGAGAGTAATCAGTTT | $A_{ks}G_{ks}A_{ks}G_{ds}A_{ds}G_{ds}T_{ds}A_{ds}A_{ds}T_{ds}{}^mC_{ds}A_{ds}G_{ks}T_{ks}T_e$ | 51 | 2651 |
| 1341509 | N/A | N/A | 14165 | 14180 | GCAAGCCAACAGAGAG | $G_{ks}{}^mC_{ks}A_{ks}A_{ds}G_{ds}{}^mC_{ds}{}^mC_{ds}A_{ds}A_{ds}{}^mC_{ds}A_{ds}G_{ds}A_{ks}G_{ks}A_{ks}G_e$ | 38 | 2556 |
| 1341511 | N/A | N/A | 14175 | 14190 | GCCTTGAATAGCAAGC | $G_{ks}{}^mC_{ks}{}^mC_{ks}T_{ds}T_{ds}G_{ds}A_{ds}A_{ds}T_{ds}A_{ds}G_{ds}{}^mC_{ds}A_{ks}A_{ks}G_{ks}{}^mC_e$ | 38 | 2063 |

TABLE 46

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^mC_{ks}A_k$ | 79 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 87 | 1526 |
| 1341648 | 1251 | 1266 | 21066 | 21081 | TGTCCACCTTTAAATG | $T_{ks}G_{ks}T_{ks}{}^mC_{ds}C_{ys}A_{ds}{}^mC_{ds}{}^mC_{ds}T_{ds}T_{ds}T_{ds}A_{ds}A_{ds}A_{ks}T_{ks}G_k$ | 17 | 1666 |
| 1341654 | 1317 | 1332 | 21132 | 21147 | GAACAGTCTTAAACCT | $G_{ks}A_{ks}A_{ks}{}^mC_{ds}A_{ys}G_{ds}T_{ds}{}^mC_{ds}T_{ds}T_{ds}A_{ds}A_{ds}A_{ds}{}^mC_{ds}{}^mC_{ks}T_k$ | 75 | 266 |
| 1341658 | 1313 | 1328 | 21128 | 21143 | AGTCUTAAACCTTCCC | $A_{ks}G_{ks}T_{ks}{}^mC_{ds}U_{ys}T_{ds}A_{ds}A_{ds}A_{ds}{}^mC_{ds}{}^mC_{ds}T_{ds}T_{ds}{}^mC_{ks}{}^mC_{ks}{}^mC_k$ | 52 | 2813 |
| 1341661 | 1321 | 1336 | 21136 | 21151 | ACTTGAACAGTCTTAA | $A_{ks}{}^mC_{ks}T_{ks}T_{ds}G_{ys}A_{ds}A_{ds}{}^mC_{ds}A_{ds}G_{ds}T_{ds}{}^mC_{ds}T_{ds}T_{ks}A_{ks}A_k$ | 29 | 578 |
| 1341663 | 1308 | 1323 | 21123 | 21138 | TAAACCTTCCCTGTGT | $T_{ks}A_{ks}A_{ks}A_{ds}C_{ys}{}^mC_{ds}T_{ds}T_{ds}{}^mC_{ds}{}^mC_{ds}{}^mC_{ds}T_{ds}G_{ds}T_{ks}G_{ks}T_k$ | 46 | 1745 |
| 1341668 | 1335 | 1350 | 21150 | 21165 | CAGAUTGGAATGCTAC | ${}^mC_{ks}A_{ks}G_{ks}A_{ds}U_{ys}T_{ds}G_{ds}G_{ds}A_{ds}A_{ds}T_{ds}G_{ds}{}^mC_{ds}T_{ks}A_{ks}{}^mC_k$ | 70 | 2814 |
| 1341672 | 1329 | 1344 | 21144 | 21159 | GGAAUGCTACTTGAAC | $G_{ks}G_{ks}A_{ks}A_{ds}U_{ys}G_{ds}{}^mC_{ds}T_{ds}A_{ds}{}^mC_{ds}T_{ds}T_{ds}G_{ds}A_{ks}A_{ks}{}^mC_k$ | 62 | 2815 |
| 1341677 | 1325 | 1340 | 21140 | 21155 | TGCTACTTGAACAGTC | $T_{ks}G_{ks}{}^mC_{ks}T_{ds}A_{ys}{}^mC_{ds}T_{ds}T_{ds}G_{ds}A_{ds}A_{ds}{}^mC_{ds}A_{ds}G_{ks}T_{ks}{}^mC_k$ | 65 | 889 |
| 1341685 | 1342 | 1357 | 21157 | 21172 | ATGGCTACAGATTGGA | $A_{ks}T_{ks}G_{ks}G_{ds}C_{ys}T_{ds}A_{ds}{}^mC_{ds}A_{ds}G_{ds}A_{ds}T_{ds}T_{ds}G_{ks}G_{ks}A_k$ | 44 | 111 |
| 1341691 | 1357 | 1372 | 21172 | 21187 | TTGAUATTCTGTGGCA | $T_{ks}T_{ks}G_{ks}A_{ds}U_{ys}A_{ds}T_{ds}T_{ds}{}^mC_{ds}T_{ds}G_{ds}T_{ds}G_{ds}G_{ks}{}^mC_{ks}A_k$ | 60 | 2816 |
| 1341692 | 1348 | 1363 | 21163 | 21178 | TGTGGCATGGCTACAG | $T_{ks}G_{ks}T_{ks}G_{ds}G_{ys}{}^mC_{ds}A_{ds}T_{ds}G_{ds}G_{ds}{}^mC_{ds}T_{ds}A_{ds}{}^mC_{ks}A_{ks}G_k$ | 5 | 579 |
| 1341697 | 1353 | 1368 | 21168 | 21183 | TATTCTGTGGCATGGC | $T_{ks}A_{ks}T_{ks}T_{ds}C_{ys}T_{ds}G_{ds}T_{ds}G_{ds}G_{ds}{}^mC_{ds}A_{ds}T_{ds}G_{ks}G_{ks}{}^mC_k$ | 55 | 890 |
| 1341698 | 1366 | 1381 | 21181 | 21196 | GTGTUCTTGTTGATAT | $G_{ks}T_{ks}G_{ks}T_{ds}U_{ys}{}^mC_{ds}T_{ds}T_{ds}G_{ds}T_{ds}T_{ds}G_{ds}A_{ds}T_{ks}A_{ks}T_k$ | 52 | 2817 |
| 1341702 | 1394 | 1409 | 21209 | 21224 | CTTGATCTCTTAGCTG | ${}^mC_{ks}T_{ks}T_{ks}G_{ds}A_{ys}T_{ds}{}^mC_{ds}T_{ds}{}^mC_{ds}T_{ds}T_{ds}A_{ds}G_{ds}{}^mC_{ks}T_{ks}G_k$ | 32 | 736 |
| 1341703 | 1388 | 1403 | 21203 | 21218 | CTCTUAGCTGTGCACT | ${}^mC_{ks}T_{ks}{}^mC_{ks}T_{ds}U_{ys}A_{ds}G_{ds}{}^mC_{ds}T_{ds}G_{ds}T_{ds}G_{ds}{}^mC_{ds}A_{ks}{}^mC_{ks}T_k$ | 67 | 2818 |

TABLE 46-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341713 | 1421 | 1436 | 21236 | 21251 | AGGTUGAGATAAAGCT | $A_{ks}G_{ks}G_{ks}T_{ds}U_{ys}G_{ds}A_{ds}G_{ds}A_{ds}T_{ds}A_{ds}A_{ds}A_{ds}G_{ks}{}^{m}C_{ks}T_{k}$ | 58 | 2819 |
| 1341716 | 696 | 711 | 12114 | 12129 | GACAUGAGGTTTTGAT | $G_{ks}A_{ks}{}^{m}C_{ks}A_{ds}U_{ys}G_{ds}A_{ds}G_{ds}G_{ds}T_{ds}T_{ds}T_{ds}T_{ds}G_{ks}A_{ks}T_{k}$ | 34 | 2820 |
| 1341719 | 1416 | 1431 | 21231 | 21246 | GAGAUAAAGCTGCCTG | $G_{ks}A_{ks}G_{ks}A_{ds}U_{ys}A_{ds}A_{ds}A_{ds}G_{ds}{}^{m}C_{ds}T_{ds}G_{ds}{}^{m}C_{ds}{}^{m}C_{ks}T_{ks}G_{k}$ | 39 | 2821 |
| 1341726 | 1426 | 1441 | 21241 | 21256 | TGTCCAGGTTGAGATA | $T_{ks}G_{ks}T_{ks}{}^{m}C_{ds}C_{ys}A_{ds}G_{ds}G_{ds}T_{ds}T_{ds}G_{ds}A_{ds}G_{ds}A_{ks}T_{ks}A_{k}$ | 41 | 191 |
| 1341727 | 1464 | 1479 | 21279 | 21294 | AGGCUAGGGAAATCTT | $A_{ks}G_{ks}G_{ks}{}^{m}C_{ds}U_{ys}A_{ds}G_{ds}G_{ds}G_{ds}A_{ds}A_{ds}A_{ds}T_{ds}{}^{m}C_{ks}T_{ks}T_{k}$ | 41 | 2822 |
| 1341729 | 1494 | 1509 | 21309 | 21324 | TGCACCGTTTTGGGCT | $T_{ks}G_{ks}{}^{m}C_{ks}A_{ds}C_{ys}{}^{m}C_{ds}G_{ds}T_{ds}T_{ds}T_{ds}T_{ds}G_{ds}G_{ds}G_{ks}{}^{m}C_{ks}T_{k}$ | 55 | 1671 |
| 1341734 | 1490 | 1505 | 21305 | 21320 | CCGTUTTGGGCTAATG | ${}^{m}C_{ks}{}^{m}C_{ks}G_{ks}T_{ds}U_{ys}T_{ds}T_{ds}G_{ds}G_{ds}G_{ds}{}^{m}C_{ds}T_{ds}A_{ds}A_{ks}T_{ks}G_{k}$ | 51 | 2823 |
| 1341739 | 1623 | 1638 | 21438 | 21453 | TAGAGTCGGTCACCTT | $T_{ks}A_{ks}G_{ks}A_{ds}G_{ys}T_{ds}{}^{m}C_{ds}G_{ds}G_{ds}T_{ds}{}^{m}C_{ds}A_{ds}{}^{m}C_{ds}{}^{m}C_{ks}T_{ks}T_{k}$ | 55 | 506 |
| 1341743 | 1598 | 1613 | 21413 | 21428 | ATCTUATAAGACTATA | $A_{ks}T_{ks}{}^{m}C_{ks}T_{ds}U_{ys}A_{ds}T_{ds}A_{ds}A_{ds}G_{ds}A_{ds}{}^{m}C_{ds}T_{ds}A_{ks}T_{ks}A_{k}$ | 35 | 2824 |
| 1341745 | 1498 | 1513 | 21313 | 21328 | GAGTUGCACCGTTTTG | $G_{ks}A_{ks}G_{ks}T_{ds}U_{ys}G_{ds}{}^{m}C_{ds}A_{ds}{}^{m}C_{ds}{}^{m}C_{ds}G_{ds}T_{ds}T_{ds}T_{ks}T_{ks}G_{k}$ | 63 | 2825 |
| 1341753 | 1615 | 1630 | 21430 | 21445 | GTCACCTTTCATAATG | $G_{ks}T_{ks}{}^{m}C_{ks}A_{ds}C_{ys}{}^{m}C_{ds}T_{ds}T_{ds}T_{ds}{}^{m}C_{ds}A_{ds}T_{ds}A_{ds}A_{ks}T_{ks}G_{k}$ | 40 | 1907 |
| 1341755 | 1619 | 1634 | 21434 | 21449 | GTCGGTCACCTTTCAT | $G_{ks}T_{ks}{}^{m}C_{ks}G_{ds}G_{ys}T_{ds}{}^{m}C_{ds}A_{ds}{}^{m}C_{ds}{}^{m}C_{ds}T_{ds}T_{ds}T_{ds}{}^{m}C_{ks}A_{ks}T_{k}$ | 66 | 194 |
| 1341758 | 1627 | 1642 | 21442 | 21457 | AAAAUAGAGTCGGTCA | $A_{ks}A_{ks}A_{ks}A_{ds}U_{ys}A_{ds}G_{ds}A_{ds}G_{ds}T_{ds}{}^{m}C_{ds}G_{ds}G_{ds}T_{ks}{}^{m}C_{ks}A_{k}$ | 62 | 2826 |
| 1341759 | 1711 | 1726 | 21526 | 21541 | CATCUCTGGGACCAAG | ${}^{m}C_{ks}A_{ks}T_{ks}{}^{m}C_{ds}U_{ys}{}^{m}C_{ds}T_{ds}G_{ds}G_{ds}G_{ds}A_{ds}{}^{m}C_{ds}{}^{m}C_{ds}A_{ks}A_{ks}G_{k}$ | 42 | 2827 |
| 1341763 | 1715 | 1730 | 21530 | 21545 | TAAACATCTCTGGGAC | $T_{ks}A_{ks}A_{ks}A_{ds}C_{ys}A_{ds}T_{ds}{}^{m}C_{ds}T_{ds}{}^{m}C_{ds}T_{ds}G_{ds}G_{ds}G_{ks}A_{ks}{}^{m}C_{k}$ | 49 | 351 |
| 1341774 | 1705 | 1720 | 21520 | 21535 | TGGGACCAAGGATATA | $T_{ks}G_{ks}G_{ks}G_{ds}A_{ys}{}^{m}C_{ds}{}^{m}C_{ds}A_{ds}A_{ds}G_{ds}G_{ds}A_{ds}T_{ds}A_{ks}T_{ks}A_{k}$ | 51 | 1674 |
| 1341777 | 796 | 811 | 15677 | 15692 | CCATCTATCAGACTTC | ${}^{m}C_{ks}{}^{m}C_{ks}A_{ks}T_{ds}C_{ys}T_{ds}A_{ds}T_{ds}{}^{m}C_{ds}A_{ds}G_{ds}A_{ds}{}^{m}C_{ds}T_{ks}T_{ks}{}^{m}C_{k}$ | 56 | 415 |
| 1341780 | 1770 | 1785 | 21585 | 21600 | AGCCAGTACAGTTCCT | $A_{ks}G_{ks}{}^{m}C_{ks}{}^{m}C_{ds}A_{ys}G_{ds}T_{ds}A_{ds}{}^{m}C_{ds}A_{ds}G_{ds}T_{ds}T_{ds}{}^{m}C_{ks}{}^{m}C_{ks}T_{k}$ | 65 | 1909 |
| 1341785 | 1751 | 1766 | 21566 | 21581 | CCTGUGTTAGCTTTAA | ${}^{m}C_{ks}{}^{m}C_{ks}T_{ks}G_{ds}U_{ys}G_{ds}T_{ds}T_{ds}A_{ds}G_{ds}{}^{m}C_{ds}T_{ds}T_{ds}T_{ks}A_{ks}A_{k}$ | 28 | 2828 |
| 1341786 | 1719 | 1734 | 21534 | 21549 | TGTCUAAACATCTCTG | $T_{ks}G_{ks}T_{ks}{}^{m}C_{ds}U_{ys}A_{ds}A_{ds}A_{ds}{}^{m}C_{ds}A_{ds}T_{ds}{}^{m}C_{ds}T_{ds}{}^{m}C_{ks}T_{ks}G_{k}$ | 44 | 2829 |
| 1341788 | 1783 | 1798 | 21598 | 21613 | TTTCUTATGTAATAGC | $T_{ks}T_{ks}T_{ks}{}^{m}C_{ds}U_{ys}T_{ds}A_{ds}T_{ds}G_{ds}T_{ds}A_{ds}A_{ds}T_{ds}A_{ks}G_{ks}{}^{m}C_{k}$ | 50 | 2830 |
| 1341793 | 1775 | 1790 | 21590 | 21605 | GTAAUAGCCAGTACAG | $G_{ks}T_{ks}A_{ks}A_{ds}U_{ys}A_{ds}G_{ds}{}^{m}C_{ds}{}^{m}C_{ds}A_{ds}G_{ds}T_{ds}A_{ds}{}^{m}C_{ks}A_{ks}G_{k}$ | 62 | 2831 |
| 1341796 | 1779 | 1794 | 21594 | 21609 | TTATGTAATAGCCAGT | $T_{ks}T_{ks}A_{ks}T_{ds}G_{ys}T_{ds}A_{ds}A_{ds}T_{ds}A_{ds}G_{ds}{}^{m}C_{ds}{}^{m}C_{ds}A_{ks}G_{ks}T_{k}$ | 56 | 586 |
| 1341800 | 2187 | 2202 | 22002 | 22017 | TGATGTAGTGGGAGTC | $T_{ks}G_{ks}A_{ks}T_{ds}G_{ys}T_{ds}A_{ds}G_{ds}T_{ds}G_{ds}G_{ds}G_{ds}A_{ds}G_{ks}T_{ks}{}^{m}C_{k}$ | 43 | 820 |

TABLE 46-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341805 | 2194 | 2209 | 22009 | 22024 | TTAGUCTTGATGTAGT | $T_{ks}T_{ks}A_{ks}G_{ds}U_{ys}{}^mC_{ds}T_{ds}T_{ds}G_{ds}A_{ds}T_{ds}G_{ds}T_{ds}A_{ks}G_{ks}T_k$ | 50 | 2832 |
| 1341809 | 2350 | 2365 | 22165 | 22180 | ACTACAAGAGGTTATT | $A_{ks}{}^mC_{ks}T_{ks}A_{ds}C_{ys}A_{ds}A_{ds}G_{ds}A_{ds}G_{ds}G_{ds}T_{ds}T_{ds}A_{ks}T_{ks}T_k$ | 29 | 899 |
| 1341810 | 2250 | 2265 | 22065 | 22080 | AGGAUAGTCCATGCAA | $A_{ks}G_{ks}G_{ks}A_{ds}U_{ys}A_{ds}G_{ds}T_{ds}{}^mC_{ds}{}^mC_{ds}A_{ds}T_{ds}G_{ds}{}^mC_{ks}A_{ks}A_k$ | 55 | 2833 |
| 1341822 | N/A | N/A | 9514 | 9529 | ACTAATATTGAGGCAC | $A_{ks}{}^mC_{ks}T_{ks}A_{ds}A_{ys}T_{ds}A_{ds}T_{ds}T_{ds}G_{ds}A_{ds}G_{ds}G_{ds}{}^mC_{ks}A_{ks}{}^mC_k$ | 42 | 1772 |
| 1341825 | N/A | N/A | 9332 | 9347 | ATCCUATATACATCCA | $A_{ks}T_{ks}{}^mC_{ks}{}^mC_{ds}U_{ys}A_{ds}T_{ds}A_{ds}T_{ds}A_{ds}{}^mC_{ds}A_{ds}T_{ds}{}^mC_{ks}{}^mC_{ks}A_k$ | 64 | 2834 |
| 1341828 | N/A | N/A | 9601 | 9616 | CATAUGTGAAGAGCTG | ${}^mC_{ks}A_{ks}T_{ks}A_{ds}U_{ys}G_{ds}T_{ds}G_{ds}A_{ds}A_{ds}G_{ds}A_{ds}G_{ds}{}^mC_{ks}T_{ks}G_k$ | 39 | 2835 |
| 1341831 | N/A | N/A | 11578 | 11593 | GTTAUTCTCTTGACAA | $G_{ks}T_{ks}T_{ks}A_{ds}U_{ys}T_{ds}{}^mC_{ds}T_{ds}{}^mC_{ds}T_{ds}T_{ds}G_{ds}A_{ds}{}^mC_{ks}A_{ks}A_k$ | 29 | 2836 |
| 1341833 | N/A | N/A | 9966 | 9981 | TAGTGTAAGCTGAGAG | $T_{ks}A_{ks}G_{ks}T_{ds}G_{ys}T_{ds}A_{ds}A_{ds}G_{ds}{}^mC_{ds}T_{ds}G_{ds}A_{ds}G_{ks}A_{ks}G_k$ | 31 | 1852 |
| 1341836 | 808 | 823 | 15689 | 15704 | TTGGUAAGTATTCCAT | $T_{ks}T_{ks}G_{ks}G_{ds}U_{ys}A_{ds}A_{ds}G_{ds}T_{ds}A_{ds}T_{ds}T_{ds}{}^mC_{ds}{}^mC_{ks}A_{ks}T_k$ | 13 | 2837 |
| 1341839 | N/A | N/A | 11546 | 11561 | TCTTGACAATGGTTGC | $T_{ks}{}^mC_{ks}T_{ks}T_{ds}G_{ys}A_{ds}{}^mC_{ds}A_{ds}A_{ds}T_{ds}G_{ds}G_{ds}T_{ds}T_{ks}G_{ks}{}^mC_k$ | 67 | 2199 |
| 1341850 | N/A | N/A | 14197 | 14212 | TTATGTGATTGAGTTC | $T_{ks}T_{ks}A_{ks}T_{ds}G_{ys}T_{ds}G_{ds}A_{ds}T_{ds}T_{ds}G_{ds}A_{ds}G_{ds}T_{ks}T_{ks}{}^mC_k$ | 35 | 2431 |
| 1341856 | N/A | N/A | 12419 | 12434 | GTAACGGTGATCAAAT | $G_{ks}T_{ks}A_{ks}A_{ds}C_{ys}G_{ds}G_{ds}T_{ds}G_{ds}A_{ds}T_{ds}{}^mC_{ds}A_{ds}A_{ks}A_{ks}T_k$ | 21 | 2345 |
| 1341863 | N/A | N/A | 15496 | 15511 | CTGCATTAATGCCACC | ${}^mC_{ks}T_{ks}G_{ks}{}^mC_{ds}A_{ys}T_{ds}T_{ds}A_{ds}A_{ds}T_{ds}G_{ds}{}^mC_{ds}{}^mC_{ds}A_{ks}{}^mC_{ks}{}^mC_k$ | 52 | 1168 |
| 1341864 | 1017 | 1032 | 20832 | 20847 | CAGCATTGATTCGAAA | ${}^mC_{ks}A_{ks}G_{ks}{}^mC_{ds}A_{ys}T_{ds}T_{ds}G_{ds}A_{ds}T_{ds}T_{ds}{}^mC_{ds}G_{ds}A_{ks}A_{ks}A_k$ | 37 | 263 |
| 1341867 | N/A | N/A | 14916 | 14931 | ATACATTAGCAAGCTA | $A_{ks}T_{ks}A_{ks}{}^mC_{ds}A_{ys}T_{ds}T_{ds}A_{ds}G_{ds}{}^mC_{ds}A_{ds}A_{ds}G_{ds}{}^mC_{ks}T_{ks}A_k$ | 36 | 309 |
| 1341871 | N/A | N/A | 16289 | 16304 | GTTAGAATAGTCTTCA | $G_{ks}T_{ks}T_{ks}A_{ds}G_{ys}A_{ds}A_{ds}T_{ds}A_{ds}G_{ds}T_{ds}{}^mC_{ds}T_{ds}T_{ks}{}^mC_{ks}A_k$ | 42 | 1481 |
| 1341873 | N/A | N/A | 16218 | 16233 | TATAGACTGGGTAGGA | $T_{ks}A_{ks}T_{ks}A_{ds}G_{ys}A_{ds}{}^mC_{ds}T_{ds}G_{ds}G_{ds}G_{ds}T_{ds}A_{ds}G_{ks}G_{ks}A_k$ | 30 | 2808 |
| 1341876 | N/A | N/A | 16127 | 16142 | CATAATAATAGCTCTA | ${}^mC_{ks}A_{ks}T_{ks}A_{ds}A_{ys}T_{ds}A_{ds}A_{ds}T_{ds}A_{ds}G_{ds}{}^mC_{ds}T_{ds}{}^mC_{ks}T_{ks}A_k$ | 33 | 2511 |
| 1341878 | N/A | N/A | 16382 | 16397 | TCCCAACCAAACTTCC | $T_{ks}{}^mC_{ks}{}^mC_{ks}{}^mC_{ds}A_{ys}A_{ds}{}^mC_{ds}{}^mC_{ds}A_{ds}A_{ds}A_{ds}{}^mC_{ds}T_{ds}T_{ks}{}^mC_{ks}{}^mC_k$ | 43 | 2026 |
| 1341885 | N/A | N/A | 17994 | 18009 | GAAGUTAGTATAGTTA | $G_{ks}A_{ks}A_{ks}G_{ds}U_{ys}T_{ds}A_{ds}G_{ds}T_{ds}A_{ds}T_{ds}A_{ds}G_{ds}T_{ks}T_{ks}A_k$ | 43 | 2838 |
| 1341892 | 1083 | 1098 | 20898 | 20913 | TGCTGCTAGTGCCAAA | $T_{ks}G_{ks}{}^mC_{ks}T_{ds}G_{ys}{}^mC_{ds}T_{ds}A_{ds}G_{ds}T_{ds}G_{ds}{}^mC_{ds}{}^mC_{ds}A_{ks}A_{ks}A_k$ | 50 | 1665 |
| 1341893 | N/A | N/A | 17989 | 18004 | TAGTATAGTTATCTTC | $T_{ks}A_{ks}G_{ks}T_{ds}A_{ys}T_{ds}A_{ds}G_{ds}T_{ds}T_{ds}A_{ds}T_{ds}{}^mC_{ds}T_{ks}T_{ks}{}^mC_k$ | 13 | 1093 |
| 1341898 | N/A | N/A | 19912 | 19927 | TGCAUCTTAAGATACC | $T_{ks}G_{ks}{}^mC_{ks}A_{ds}U_{ys}{}^mC_{ds}T_{ds}T_{ds}A_{ds}A_{ds}G_{ds}A_{ds}T_{ds}A_{ks}{}^mC_{ks}{}^mC_k$ | 51 | 2839 |
| 1341903 | N/A | N/A | 18690 | 18705 | CTTTGAGACTCTTGTT | ${}^mC_{ks}T_{ks}T_{ks}T_{ds}G_{ys}A_{ds}G_{ds}A_{ds}{}^mC_{ds}T_{ds}{}^mC_{ds}T_{ds}T_{ds}G_{ks}T_{ks}T_k$ | 15 | 2583 |

TABLE 46-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341905 | N/A | N/A | 18092 | 18107 | TGATACACCAATGCAG | $T_{ks}G_{ks}A_{ds}T_{ds}A_{ys}{}^mCdsA_{ds}{}^mC_{ds}$ ${}^mC_{ds}A_{ds}A_{ds}T_{ds}G_{ds}{}^mC_{ks}A_{ks}G_k$ | 38 | 2370 |
| 1341910 | N/A | N/A | 19904 | 19919 | AAGAUACCCAGGTTGC | $A_{ks}A_{ks}G_{ks}A_{ds}U_{ys}A_{ds}{}^mC_{ds}{}^mC_{ds}$ ${}^mC_{ds}A_{ds}G_{ds}G_{ds}T_{ds}T_{ks}G_{ks}{}^mC_k$ | 37 | 2840 |
| 1341913 | 608 | 623 | N/A | N/A | ACAAUATGGGATGAGG | $A_{ks}{}^mC_{ks}A_{ks}A_{ds}U_{ys}A_{ds}T_{ds}G_{ds}$ $G_{ds}G_{ds}A_{ds}T_{ds}G_{ds}A_{ks}G_{ks}G_k$ | 70 | 2841 |
| 1341916 | N/A | N/A | 19908 | 19923 | TCTTAAGATACCCAGG | $T_{ks}{}^mC_{ks}T_{ks}T_{ds}A_{ys}A_{ds}G_{ds}A_{ds}T_{ds}$ $A_{ds}{}^mC_{ds}{}^mC_{ds}{}^mC_{ds}A_{ks}G_{ks}G_k$ | 51 | 319 |
| 1341918 | N/A | N/A | 19916 | 19931 | GGAGUGCATCTTAAGA | $G_{ks}G_{ks}A_{ks}G_{ds}U_{ys}G_{ds}{}^mC_{ds}A_{ds}$ $T_{ds}{}^mC_{ds}T_{ds}T_{ds}A_{ds}A_{ks}G_{ks}A_k$ | 32 | 2842 |
| 1341920 | N/A | N/A | 20112 | 20127 | ATCAAGACATTCTAGC | $A_{ks}T_{ks}{}^mC_{ks}A_{ks}A_{ys}G_{ds}A_{ds}{}^mC_{ds}$ $A_{ds}T_{ds}T_{ds}{}^mC_{ds}T_{ds}A_{ds}G_{ks}{}^mC_k$ | 37 | 1488 |
| 1341927 | 1079 | 1094 | 20894 | 20909 | GCTAGTGCCAAACCAA | $G_{ks}{}^mC_{ks}T_{ks}A_{ds}G_{ys}T_{ds}G_{ds}{}^mC_{ds}$ ${}^mC_{ds}A_{ds}A_{ds}A_{ds}{}^mC_{ds}{}^mC_{ks}A_{ks}A_k$ | 65 | 1354 |
| 1341929 | N/A | N/A | 20385 | 20400 | TAGTAATCACAAGTAA | $T_{ks}A_{ks}G_{ks}T_{ds}A_{ys}A_{ds}T_{ds}{}^mC_{ds}A_{ds}$ ${}^mC_{ds}A_{ds}A_{ds}G_{ds}T_{ds}A_{ks}A_k$ | 38 | 1489 |
| 1341931 | N/A | N/A | 20197 | 20212 | ACATUGCAGTTATTAG | $A_{ks}{}^mC_{ks}A_{ks}T_{ds}U_{ys}G_{ds}{}^mC_{ds}A_{ds}$ $G_{ds}T_{ds}T_{ds}A_{ds}T_{ds}T_{ks}A_{ks}G_k$ | 26 | 2843 |
| 1341936 | N/A | N/A | 20187 | 20202 | TATTAGAAGTCAGCCC | $T_{ks}A_{ks}T_{ks}T_{ds}A_{ys}G_{ds}A_{ds}A_{ds}G_{ds}$ $T_{ds}{}^mC_{ds}A_{ds}G_{ds}{}^mC_{ks}{}^mC_{ks}{}^mC_k$ | 29 | 164 |
| 1341940 | N/A | N/A | 20482 | 20497 | TCATAGTGGACTTCAT | $T_{ks}{}^mC_{ks}A_{ks}T_{ds}A_{ys}G_{ds}T_{ds}G_{ds}G_{ds}$ $A_{ds}{}^mC_{ds}T_{ds}T_{ds}{}^mC_{ks}A_{ks}T_k$ | 44 | 633 |
| 1341946 | 1075 | 1090 | 20890 | 20905 | GTGCCAAACCAATGTT | $G_{ks}T_{ks}G_{ks}{}^mC_{ds}C_{ys}A_{ds}A_{ds}A_{ds}$ ${}^mC_{ds}{}^mC_{ds}A_{ds}A_{ds}T_{ds}G_{ks}T_{ks}T_k$ | 30 | 1042 |
| 1341951 | N/A | N/A | 12801 | 12816 | AGGCUGTAAGAGTCAG | $A_{ks}G_{ks}G_{ks}{}^mC_{ds}U_{ys}G_{ds}T_{ds}A_{ds}$ $A_{ds}G_{ds}A_{ds}G_{ds}T_{ds}{}^mC_{ks}A_{ks}G_k$ | 52 | 2844 |
| 1341955 | N/A | N/A | 12496 | 12511 | AATTCACCTTGACTAA | $A_{ks}A_{ks}T_{ks}T_{ds}C_{ys}A_{ds}{}^mC_{ds}{}^mC_{ds}$ $T_{ds}T_{ds}G_{ds}A_{ds}{}^mC_{ds}T_{ks}A_{ks}A_k$ | 0 | 2144 |

TABLE 47

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}$ $T_{ds}A_{ds}A_{ds}G_{ds}T_{ks}{}^mC_{ks}A_k$ | 86 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}$ $A_{ds}T_{ds}T_{ds}{}^mC_{ds}A_{ks}G_{ks}T_k$ | 87 | 1526 |
| 1341649 | 1314 | 1329 | 21129 | 21144 | CAGTCTTAAACCTTCC | ${}^mC_{ks}A_{ks}G_{ks}T_{ds}C_{ys}T_{ds}T_{ds}A_{ds}A_{ds}$ $A_{ds}{}^mC_{ds}{}^mC_{ds}T_{ds}T_{ks}{}^mC_{ks}{}^mC_k$ | 59 | 30 |
| 1341652 | 1318 | 1333 | 21133 | 21148 | TGAACAGTCTTAAACC | $T_{ks}G_{ks}A_{ks}A_{ds}C_{ys}A_{ds}G_{ds}T_{ds}{}^mC_{ds}$ $T_{ds}T_{ds}A_{ds}A_{ds}A_{ks}{}^mCk{}^mC_k$ | 57 | 344 |
| 1341655 | 1256 | 1271 | 21071 | 21086 | GCTTUTGTCCACCTTT | $G_{ks}{}^mC_{ks}T_{ks}T_{ds}U_{ys}T_{ds}G_{ds}T_{ds}{}^mC_{ds}$ ${}^mC_{ds}A_{ds}{}^mC_{ds}{}^mC_{ds}T_{ks}T_{ks}T_k$ | 75 | 2845 |
| 1341666 | 1309 | 1324 | 21124 | 21139 | TTAAACCTTCCCTGTG | $T_{ks}T_{ks}A_{ks}A_{ds}A_{ys}{}^mC_{ds}{}^mC_{ds}T_{ds}$ $T_{ds}{}^mC_{ds}{}^mC_{ds}{}^mC_{ds}T_{ds}G_{ks}T_{ks}G_k$ | 23 | 2807 |

TABLE 47-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341669 | 1326 | 1341 | 21141 | 21156 | ATGCUACTTGAACAGT | $A_{ks}T_{ks}G_{ks}{}^mG_{ds}U_{ys}A_{ds}{}^mC_{ds}T_{ds}T_{ds}G_{ds}A_{ds}A_{ds}{}^mC_{ds}A_{ks}G_{ks}T_{k}$ | 46 | 2846 |
| 1341671 | 1330 | 1345 | 21145 | 21160 | TGGAATGCTACTTGAA | $T_{ks}G_{ks}G_{ks}A_{ds}A_{ys}T_{ds}G_{ds}{}^mC_{ds}T_{ds}A_{ds}{}^mC_{ds}T_{ds}T_{ds}G_{ks}A_{ks}A_{k}$ | 79 | 2203 |
| 1341673 | 1336 | 1351 | 21151 | 21166 | ACAGATTGGAATGCTA | $A_{ks}{}^mC_{ks}A_{ks}G_{ds}A_{ys}T_{ds}T_{ds}G_{ds}G_{ds}A_{ds}A_{ds}T_{ds}G_{ds}{}^mC_{ks}T_{ks}A_{k}$ | 70 | 1668 |
| 1341674 | 1322 | 1337 | 21137 | 21152 | TACTUGAACAGTCTTA | $T_{ks}A_{ks}{}^mC_{ks}T_{ds}U_{ys}G_{ds}A_{ds}A_{ds}{}^mC_{ds}A_{ds}G_{ds}T_{ds}{}^mC_{ds}T_{ks}T_{ks}A_{k}$ | 38 | 2847 |
| 1341686 | 1344 | 1359 | 21159 | 21174 | GCATGGCTACAGATTG | $G_{ks}{}^mC_{ks}A_{ks}T_{ds}G_{ds}G_{ds}{}^mC_{ds}T_{ds}A_{ds}{}^mC_{ds}A_{ds}G_{ds}A_{ds}T_{ks}T_{ks}G_{k}$ | 76 | 267 |
| 1341689 | 1354 | 1369 | 21169 | 21184 | ATATUCTGTGGCATGG | $A_{ks}T_{ks}A_{ks}T_{ds}U_{ys}{}^mC_{ds}T_{ds}G_{ds}T_{ds}G_{ds}G_{ds}{}^mC_{ds}A_{ds}T_{ks}G_{ks}G_{k}$ | 63 | 2848 |
| 1341693 | 1358 | 1373 | 21173 | 21188 | GTTGATATTCTGTGGC | $G_{ks}T_{ks}T_{ks}G_{ds}A_{ys}T_{ds}A_{ds}T_{ds}T_{ds}{}^mC_{ds}T_{ds}G_{ds}T_{ds}G_{ks}G_{ks}{}^mC_{k}$ | 68 | 1280 |
| 1341694 | 1349 | 1364 | 21164 | 21179 | CTGTGGCATGGCTACA | ${}^mC_{ks}T_{ks}G_{ks}T_{ds}G_{ys}G_{ds}{}^mC_{ds}A_{ds}T_{ds}G_{ds}G_{ds}{}^mC_{ds}T_{ds}A_{ks}{}^mC_{ks}A_{k}$ | 35 | 657 |
| 1341701 | 1389 | 1404 | 21204 | 21219 | TCTCUTAGCTGTGCAC | $T_{ks}{}^mC_{ks}T_{ks}{}^mC_{ds}U_{ys}T_{ds}A_{ds}G_{ds}{}^mC_{ds}T_{ds}G_{ds}T_{ds}G_{ds}{}^mC_{ks}A_{ks}{}^mC_{k}$ | 49 | 2849 |
| 1341706 | 1367 | 1382 | 21182 | 21197 | TGTGUCTTGTTGATA | $T_{ks}G_{ks}T_{ks}G_{ds}U_{ys}T_{ds}{}^mC_{ds}T_{ds}T_{ds}G_{ds}T_{ds}T_{ds}G_{ds}A_{ks}T_{ks}A_{k}$ | 41 | 2850 |
| 1341707 | 698 | 713 | 12116 | 12131 | GAGACATGAGGTTTTG | $G_{ks}A_{ks}G_{ks}A_{ds}{}^mC_{ys}A_{ds}T_{ds}G_{ds}A_{ds}G_{ds}G_{ds}T_{ds}T_{ds}T_{ks}T_{ks}G_{k}$ | 61 | 725 |
| 1341708 | 1395 | 1410 | 21210 | 21225 | ACTTGATCTCTTAGCT | $A_{ks}{}^mC_{ks}T_{ks}T_{ds}G_{ds}A_{ds}T_{ds}{}^mC_{ds}T_{ds}{}^mC_{ds}T_{ds}T_{ds}A_{ds}G_{ks}{}^mC_{ks}T_{k}$ | 39 | 813 |
| 1341709 | 1418 | 1433 | 21233 | 21248 | TTGAGATAAAGCTGCC | $T_{ks}T_{ks}G_{ks}A_{ds}G_{ys}A_{ds}T_{ds}A_{ds}A_{ds}A_{ds}G_{ds}{}^mC_{ds}T_{ds}G_{ks}{}^mC_{ks}{}^mC_{k}$ | 51 | 1670 |
| 1341717 | 1422 | 1437 | 21237 | 21252 | CAGGUTGAGATAAAGC | ${}^mC_{ks}A_{ks}G_{ks}G_{ds}U_{ys}T_{ds}G_{ds}A_{ds}G_{ds}A_{ds}T_{ds}A_{ds}A_{ds}A_{ks}G_{ks}{}^mC_{k}$ | 55 | 2851 |
| 1341722 | 1466 | 1481 | 21281 | 21296 | AGAGGCTAGGGAAATC | $A_{ks}G_{ks}A_{ks}G_{ds}G_{ys}{}^mC_{ds}T_{ds}A_{ds}G_{ds}G_{ds}G_{ds}A_{ds}A_{ds}A_{ks}T_{ks}{}^mC_{k}$ | 48 | 1048 |
| 1341723 | 1429 | 1444 | 21244 | 21259 | ATATGTCCAGGTTGAG | $A_{ks}T_{ks}A_{ks}T_{ds}G_{ys}T_{ds}{}^mC_{ds}{}^mC_{ds}A_{ds}G_{ds}G_{ds}T_{ds}T_{ds}G_{ks}A_{ks}G_{k}$ | 48 | 425 |
| 1341733 | 1491 | 1506 | 21306 | 21321 | ACCGUTTTGGGCTAAT | $A_{ks}{}^mC_{ks}{}^mC_{ks}G_{ds}U_{ys}T_{ds}T_{ds}T_{ds}G_{ds}G_{ds}G_{ds}{}^mC_{ds}T_{ds}A_{ks}A_{ks}T_{k}$ | 65 | 2852 |
| 1341737 | 1495 | 1510 | 21310 | 21325 | TTGCACCGTTTTGGGC | $T_{ks}T_{ks}G_{ks}{}^mC_{ds}A_{ys}{}^mC_{ds}{}^mC_{ds}G_{ds}T_{ds}T_{ds}T_{ds}T_{ds}G_{ds}G_{ks}G_{ks}{}^mC_{k}$ | 50 | 1749 |
| 1341740 | 1499 | 1514 | 21314 | 21329 | AGAGUTGCACCGTTTT | $A_{ks}G_{ks}A_{ks}G_{ds}U_{ys}T_{ds}G_{ds}{}^mC_{ds}A_{ds}{}^mC_{ds}{}^mC_{ds}G_{ds}T_{ds}T_{ks}T_{ks}T_{k}$ | 68 | 2853 |
| 1341741 | 1624 | 1639 | 21439 | 21454 | ATAGAGTCGGTCACCT | $A_{ks}T_{ks}A_{ks}G_{ds}A_{ys}G_{ds}T_{ds}{}^mC_{ds}G_{ds}G_{ds}T_{ds}{}^mC_{ds}A_{ds}{}^mC_{ks}{}^mC_{ks}T_{k}$ | 50 | 584 |
| 1341742 | 1600 | 1615 | 21415 | 21430 | GTATCTTATAAGACTA | $G_{ks}T_{ks}A_{ks}T_{ds}{}^mC_{ys}T_{ds}T_{ds}A_{ds}T_{ds}A_{ds}A_{ds}G_{ds}A_{ds}{}^mC_{ks}T_{ks}A_{k}$ | 79 | 1595 |
| 1341751 | 1616 | 1631 | 21431 | 21446 | GGTCACCTTTCATAAT | $G_{ks}G_{ks}T_{ks}{}^mC_{ds}A_{ys}{}^mC_{ds}{}^mC_{ds}T_{ds}T_{ds}T_{ds}{}^mC_{ds}A_{ds}T_{ds}A_{ks}A_{ks}T_{k}$ | 48 | 1985 |
| 1341756 | 798 | 813 | 15679 | 15694 | TTCCATCTATCAGACT | $T_{ks}T_{ks}{}^mC_{ks}{}^mC_{ds}A_{ys}T_{ds}{}^mC_{ds}T_{ds}A_{ds}T_{ds}{}^mC_{ds}A_{ds}G_{ds}A_{ks}{}^mC_{ks}T_{k}$ | 38 | 571 |
| 1341757 | 1620 | 1635 | 21435 | 21450 | AGTCGGTCACCTTTCA | $A_{ks}G_{ks}T_{ks}{}^mC_{ds}G_{ys}G_{ds}T_{ds}{}^mC_{ds}A_{ds}{}^mC_{ds}{}^mC_{ds}T_{ds}T_{ds}T_{ks}{}^mC_{ks}A_{k}$ | 61 | 272 |

TABLE 47-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341760 | 1712 | 1727 | 21527 | 21542 | ACATCTCTGGGACCAA | $A_{ks}{}^mC_{ks}A_{ks}T_{ds}C_{ys}T_{ds}{}^mC_{ds}T_{ds}G_{ds}G_{ds}G_{ds}A_{ds}{}^mC_{ds}{}^mC_{ks}A_{ks}A_k$ | 68 | 195 |
| 1341765 | 1628 | 1643 | 21443 | 21458 | TAAAATAGAGTCGGTC | $T_{ks}A_{ks}A_{ks}A_{ds}A_{ys}T_{ds}A_{ds}G_{ds}A_{ds}G_{ds}T_{ds}{}^mC_{ds}G_{ds}G_{ks}T_{ks}{}^mC_k$ | 52 | 895 |
| 1341770 | 1721 | 1736 | 21536 | 21551 | ATTGUCTAAACATCTC | $A_{ks}T_{ks}T_{ks}G_{ds}U_{ys}{}^mC_{ds}T_{ds}A_{ds}A_{ds}{}^mC_{ds}A_{ds}T_{ds}{}^mC_{ks}T_{ks}{}^mC_k$ | 73 | 2854 |
| 1341771 | 1716 | 1731 | 21531 | 21546 | CTAAACATCTCTGGGA | ${}^mC_{ks}T_{ks}A_{ks}A_{ds}A_{ys}{}^mC_{ds}A_{ds}T_{ds}{}^mC_{ds}T_{ds}{}^mC_{ds}T_{ds}G_{ds}G_{ks}G_{ks}A_k$ | 32 | 2259 |
| 1341776 | 1707 | 1722 | 21522 | 21537 | TCTGGGACCAAGGATA | $T_{ks}{}^mC_{ks}T_{ks}G_{ds}G_{ds}G_{ds}A_{ds}{}^mC_{ds}{}^mC_{ds}A_{ds}A_{ds}G_{ds}G_{ds}A_{ks}T_{ks}A_k$ | 31 | 1830 |
| 1341779 | 1752 | 1767 | 21567 | 21582 | TCCTGTGTTAGCTTTA | $T_{ks}{}^mC_{ks}{}^mC_{ks}T_{ds}G_{ys}T_{ds}G_{ds}T_{ds}T_{ds}A_{ds}G_{ds}{}^mC_{ds}T_{ds}T_{ks}T_{ks}A_k$ | 72 | 1442 |
| 1341784 | 1771 | 1786 | 21586 | 21601 | TAGCCAGTACAGTTCC | $T_{ks}A_{ks}G_{ks}{}^mC_{ds}C_{ys}A_{ds}G_{ds}T_{ds}A_{ds}{}^mC_{ds}A_{ds}G_{ds}T_{ds}T_{ks}{}^mC_{ks}{}^mC_k$ | 70 | 1987 |
| 1341791 | 1784 | 1799 | 21599 | 21614 | GTTTCTTATGTAATAG | $G_{ks}T_{ks}T_{ks}T_{ds}C_{ys}T_{ds}T_{ds}A_{ds}T_{ds}G_{ds}T_{ds}A_{ds}A_{ds}T_{ks}A_{ks}G_k$ | 25 | 897 |
| 1341795 | 1776 | 1791 | 21591 | 21606 | TGTAATAGCCAGTACA | $T_{ks}G_{ks}T_{ks}A_{ds}A_{ys}T_{ds}A_{ds}G_{ds}{}^mC_{ds}{}^mC_{ds}A_{ds}G_{ds}T_{ds}A_{ks}{}^mC_{ks}A_k$ | 40 | 352 |
| 1341797 | 1780 | 1795 | 21595 | 21610 | CTTAUGTAATAGCCAG | ${}^mC_{ks}T_{ks}T_{ks}A_{ds}U_{ys}G_{ds}T_{ds}A_{ds}A_{ds}T_{ds}A_{ds}G_{ds}{}^mC_{ds}{}^mC_{ks}A_{ks}G_k$ | 75 | 2855 |
| 1341799 | 2196 | 2211 | 22011 | 22026 | GATTAGTCTTGATGTA | $G_{ks}A_{ks}T_{ks}T_{ds}A_{ys}G_{ds}T_{ds}mG_{ds}T_{ds}T_{ds}G_{ds}A_{ds}T_{ds}G_{ks}T_{ks}A_k$ | 45 | 1521 |
| 1341804 | 2189 | 2204 | 22004 | 22019 | CTTGATGTAGTGGGAG | ${}^mG_{ks}T_{ks}T_{ks}G_{ds}A_{ys}T_{ds}G_{ds}T_{ds}A_{ds}G_{ds}T_{ds}G_{ds}G_{ds}G_{ks}A_{ks}G_k$ | 67 | 976 |
| 1341808 | 2353 | 2368 | 22168 | 22183 | ATAACTACAAGAGGTT | $A_{ks}T_{ks}A_{ks}A_{ds}C_{ys}T_{ds}A_{ds}{}^mC_{ds}A_{ds}A_{ds}G_{ds}A_{ds}G_{ds}G_{ks}T_{ks}T_k$ | 61 | 1133 |
| 1341813 | 2252 | 2267 | 22067 | 22082 | AGAGGATAGTCCATGC | $A_{ks}G_{ks}A_{ks}G_{ds}G_{ys}A_{ds}T_{ds}A_{ds}G_{ds}T_{ds}{}^mC_{ds}{}^mC_{ds}A_{ds}T_{ks}G_{ks}{}^mC_k$ | 53 | 354 |
| 1341818 | 610 | 625 | N/A | N/A | GAACAATATGGGATGA | $G_{ks}A_{ks}A_{ks}{}^mC_{ds}A_{ys}A_{ds}T_{ds}A_{ds}T_{ds}G_{ds}G_{ds}G_{ds}A_{ds}T_{ks}G_{ks}A_k$ | 50 | 1735 |
| 1341823 | N/A | N/A | 9516 | 9531 | ACACUAATATTGAGGC | $A_{ks}{}^mC_{ks}A_{ks}{}^mC_{ds}U_{ys}A_{ds}A_{ds}T_{ds}A_{ds}T_{ds}T_{ds}G_{ds}A_{ds}G_{ks}G_{ks}{}^mC_k$ | 43 | 2856 |
| 1341824 | 810 | 825 | 15691 | 15706 | TATTGGTAAGTATTCC | $T_{ks}A_{ks}T_{ks}T_{ds}G_{ys}G_{ds}T_{ds}A_{ds}A_{ds}G_{ds}T_{ds}A_{ds}T_{ds}T_{ks}{}^mC_{ks}{}^mC_k$ | 41 | 1272 |
| 1341826 | N/A | N/A | 9334 | 9349 | CGATCCTATATACATC | ${}^mC_{ks}G_{ks}A_{ks}T_{ds}C_{ys}{}^mC_{ds}T_{ds}A_{ds}T_{ds}A_{ds}T_{ds}A_{ds}{}^mC_{ds}A_{ks}T_{ks}{}^mC_k$ | 28 | 2788 |
| 1341835 | N/A | N/A | 9968 | 9983 | AGTAGTGTAAGCTGAG | $A_{ks}G_{ks}T_{ks}A_{ds}G_{ys}T_{ds}G_{ds}T_{ds}A_{ds}A_{ds}G_{ds}{}^mC_{ds}T_{ds}G_{ks}A_{ks}G_k$ | 68 | 2155 |
| 1341837 | N/A | N/A | 9603 | 9618 | CACAUATGTGAAGAGC | ${}^mCkSA_{ks}{}^mC_{ks}A_{ds}U_{ys}A_{ds}T_{ds}G_{ds}T_{ds}G_{ds}A_{ds}A_{ds}G_{ds}A_{ks}G_{ks}{}^mC_k$ | 65 | 2857 |
| 1341843 | N/A | N/A | 11568 | 11583 | TGACAATGGTTGATAG | $T_{ks}G_{ks}A_{ks}{}^mC_{ds}A_{ys}A_{ds}T_{ds}G_{ds}G_{ds}T_{ds}T_{ds}G_{ds}A_{ds}T_{ks}A_{ks}G_k$ | 42 | 1700 |
| 1341844 | N/A | N/A | 11853 | 11868 | AGCAGAATTGTGAACG | $A_{ks}G_{ks}{}^mC_{ks}A_{ds}G_{ys}A_{ds}A_{ds}T_{ds}T_{ds}G_{ds}T_{ds}G_{ds}A_{ds}A_{ks}{}^mC_{ks}G_k$ | 51 | 844 |
| 1341848 | N/A | N/A | 12421 | 12436 | TGGTAACGGTGATCAA | $T_{ks}G_{ks}G_{ks}T_{ds}A_{ys}A_{ds}{}^mC_{ds}G_{ds}G_{ds}T_{ds}G_{ds}A_{ds}T_{ds}{}^mC_{ks}A_{ks}A_k$ | 41 | 67 |
| 1341854 | N/A | N/A | 14199 | 14214 | TATTATGTGATTGAGT | $T_{ks}A_{ks}T_{ks}T_{ds}A_{ys}T_{ds}G_{ds}T_{ds}G_{ds}A_{ds}T_{ds}T_{ds}G_{ds}A_{ks}G_{ks}T_k$ | 28 | 73 |

TABLE 47-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341858 | N/A | N/A | 14918 | 14933 | TAATACATTAGCAAGC | $T_{ks}A_{ks}A_{ks}T_{ds}A_{ys}{}^mC_{ds}A_{ds}T_{ds}T_{ds}A_{ds}G_{ds}{}^mC_{ds}A_{ds}A_{ks}G_{ks}{}^mC_k$ | 26 | 2266 |
| 1341865 | 1019 | 1034 | 20834 | 20849 | TGCAGCATTGATTCGA | $T_{ks}G_{ks}{}^mC_{ks}A_{ds}G_{ys}{}^mC_{ds}A_{ds}T_{ds}T_{ds}G_{ds}A_{ds}T_{ds}T_{ds}{}^mC_{ks}G_{ks}A_k$ | 65 | 419 |
| 1341866 | N/A | N/A | 15498 | 15513 | TGCTGCATTAATGCCA | $T_{ks}G_{ks}{}^mC_{ks}T_{ds}G_{ys}{}^mC_{ds}A_{ds}T_{ds}T_{ds}A_{ds}A_{ds}T_{ds}G_{ds}{}^mC_{ks}{}^mC_{ks}A_k$ | 32 | 2485 |
| 1341869 | N/A | N/A | 16129 | 16144 | TCCAUAATAATAGCTC | $T_{ks}{}^mC_{ks}{}^mC_{ks}A_{ds}U_{ys}A_{ds}A_{ds}T_{ds}A_{ds}A_{ds}T_{ds}A_{ds}G_{ds}{}^mC_{ks}T_{ks}{}^mC_k$ | 58 | 2858 |
| 1341872 | N/A | N/A | 16292 | 16307 | TTAGUTAGAATAGTCT | $T_{ks}T_{ks}A_{ks}G_{ds}U_{ys}T_{ds}A_{ds}G_{ds}A_{ds}A_{ds}T_{ds}A_{ds}GdST_{ks}{}^mC_{ks}T_k$ | 35 | 2859 |
| 1341875 | N/A | N/A | 16223 | 16238 | CTTTUTATAGACTGGG | ${}^mC_{ks}T_{ks}T_{ks}T_{ds}U_{ys}T_{ds}A_{ds}T_{ds}A_{ds}G_{ds}A_{ds}{}^mC_{ds}T_{ds}G_{ks}G_{ks}G_k$ | 34 | 2860 |
| 1341879 | N/A | N/A | 17990 | 18005 | TTAGUATAGTTATCTT | $T_{ks}T_{ks}A_{ks}G_{ds}U_{ys}A_{ds}T_{ds}A_{ds}G_{ds}T_{ds}T_{ds}A_{ds}T_{ds}{}^mC_{ks}T_{ks}T_k$ | 22 | 2861 |
| 1341881 | N/A | N/A | 17995 | 18010 | TGAAGTTAGTATAGTT | $T_{ks}G_{ks}A_{ks}A_{ds}G_{ys}T_{ds}T_{ds}A_{ds}G_{ds}T_{ds}A_{ds}T_{ds}A_{ds}G_{ks}T_{ks}T_k$ | 62 | 1405 |
| 1341884 | N/A | N/A | 16384 | 16399 | AATCCCAACCAAACTT | $A_{ks}A_{ks}T_{ks}{}^mC_{ys}{}^mC_{ds}A_{ds}A_{ds}{}^mC_{ds}{}^mC_{ds}A_{ds}A_{ds}A_{ds}{}^mC_{ks}T_{ks}T_k$ | 7 | 2755 |
| 1341888 | N/A | N/A | 18095 | 18110 | AATTGATACACCAATG | $A_{ks}A_{ks}T_{ks}T_{ds}G_{ys}A_{ds}T_{ds}A_{ds}{}^mC_{ds}A_{ds}{}^mC_{ds}{}^mC_{ds}A_{ds}A_{ks}T_{ks}G_k$ | 40 | 2525 |
| 1341897 | 1084 | 1099 | 20899 | 20914 | CTGCUGCTAGTGCCAA | ${}^mC_{ks}T_{ks}G_{ks}{}^mC_{ds}U_{ys}G_{ds}{}^mC_{ds}T_{ds}A_{ds}G_{ds}T_{ds}G_{ds}{}^mC_{ds}{}^mC_{ks}A_{ks}A_k$ | 66 | 2862 |
| 1341902 | N/A | N/A | 19913 | 19928 | GTGCATCTTAAGATAC | $G_{ks}T_{ks}G_{ks}{}^mC_{ds}A_{ys}T_{ds}{}^mC_{ds}T_{ds}T_{ds}A_{ds}A_{ds}G_{ds}A_{ds}T_{ks}A_{ks}{}^mC_k$ | 40 | 2806 |
| 1341906 | N/A | N/A | 18693 | 18708 | AGACUTTGAGACTCTT | $A_{ks}G_{ks}A_{ks}{}^mC_{ds}U_{ys}T_{ds}T_{ds}G_{ds}A_{ds}G_{ds}A_{ds}{}^mC_{ds}T_{ds}{}^mC_{ks}T_{ks}T_k$ | 48 | 2863 |
| 1341909 | N/A | N/A | 19909 | 19924 | ATCTUAAGATACCCAG | $A_{ks}T_{ks}{}^mC_{ks}T_{ds}U_{ys}A_{ds}A_{ds}G_{ds}A_{ds}T_{ds}A_{ds}{}^mC_{ds}{}^mC_{ds}{}^mC_{ks}A_{ks}G_k$ | 55 | 2864 |
| 1341911 | 1080 | 1095 | 20895 | 20910 | TGCTAGTGCCAAACCA | $T_{ks}G_{ks}{}^mC_{ks}T_{ds}A_{ys}G_{ds}T_{ds}G_{ds}{}^mC_{ds}{}^mC_{ds}A_{ds}A_{ds}A_{ds}{}^mC_{ks}{}^mC_{ks}A_k$ | 80 | 1432 |
| 1341912 | N/A | N/A | 19905 | 19920 | TAAGATACCCAGGTTG | $T_{ks}A_{ks}A_{ks}G_{ds}A_{ys}T_{ds}A_{ds}{}^mC_{ds}{}^mC_{ds}{}^mC_{ds}A_{ds}G_{ds}G_{ds}T_{ks}T_{ks}G_k$ | 11 | 2790 |
| 1341922 | N/A | N/A | 20114 | 20129 | GCATCAAGACATTCTA | $G_{ks}{}^mC_{ks}A_{ks}T_{ds}{}^mC_{ys}A_{ds}A_{ds}G_{ds}A_{ds}{}^mC_{ds}A_{ds}T_{ds}T_{ds}{}^mC_{ks}T_{ks}A_k$ | 51 | 1565 |
| 1341926 | N/A | N/A | 19999 | 20014 | CAGTUTTCCTCATGAT | ${}^mC_{ks}A_{ks}G_{ks}T_{ds}U_{ys}T_{ds}T_{ds}{}^mC_{ds}{}^mC_{ds}T_{ds}{}^mC_{ds}A_{ds}T_{ds}G_{ks}A_{ks}T_k$ | 0 | 2865 |
| 1341932 | 1076 | 1091 | 20891 | 20906 | AGTGCCAAACCAATGT | $A_{ks}G_{ks}T_{ks}G_{ds}{}^mC_{ys}{}^mC_{ds}A_{ds}A_{ds}A_{ds}{}^mC_{ds}{}^mC_{ds}A_{ds}A_{ds}T_{ks}G_{ks}T_k$ | 24 | 1120 |
| 1341933 | N/A | N/A | 20388 | 20403 | CTATAGTAATCACAAG | ${}^mC_{ks}T_{ks}A_{ks}T_{ds}A_{ys}G_{ds}T_{ds}A_{ds}A_{ds}T_{ds}{}^mC_{ds}A_{ds}{}^mC_{ds}A_{ks}A_{ks}G_k$ | 37 | 1644 |
| 1341935 | N/A | N/A | 20190 | 20205 | AGTTATTAGAAGTCAG | $A_{ks}G_{ks}T_{ks}T_{ds}A_{ys}T_{ds}T_{ds}A_{ds}G_{ds}A_{ds}A_{ds}G_{ds}T_{ds}{}^mC_{ks}A_{ks}G_k$ | 25 | 2746 |
| 1341938 | N/A | N/A | 20378 | 20393 | CACAAGTAAGGTAAAG | ${}^mC_{ks}A_{ks}{}^mC_{ks}A_{ds}A_{ys}G_{ds}T_{ds}A_{ds}A_{ds}G_{ds}G_{ds}T_{ds}A_{ds}A_{ks}A_{ks}G_k$ | 43 | 2448 |
| 1341944 | N/A | N/A | 20484 | 20499 | CTTCATAGTGGACTTC | ${}^mC_{ks}T_{ks}T_{ks}{}^mC_{ds}A_{ys}T_{ds}A_{ds}G_{ds}T_{ds}G_{ds}G_{ds}A_{ds}{}^mC_{ds}T_{ks}T_{ks}{}^mC_k$ | 35 | 711 |

TABLE 47-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341952 | N/A | N/A | 12804 | 12819 | CTCAGGCTGTAAGAGT | $^mC_{ks}T_{ks}{}^mC_{ks}A_{ds}G_{ys}G_{ds}{}^mC_{ds}T_{ds}G_{ds}T_{ds}A_{ds}A_{ds}G_{ds}A_{ks}G_{ks}T_k$ | 46 | 2240 |
| 1341956 | N/A | N/A | 12499 | 12514 | AGAAATTCACCTTGAC | $A_{ks}G_{ks}A_{ks}A_{ds}A_{ys}T_{ds}T_{ds}{}^mC_{ds}A_{ds}{}^mC_{ds}{}^mC_{ds}T_{ds}T_{ds}G_{ks}A_{ks}{}^mC_k$ | 9 | 2284 |

TABLE 48

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^mC_{ks}A_k$ | 82 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 86 | 1526 |
| 1341651 | 1315 | 1330 | 21130 | 21145 | ACAGUCTTAAACCTTC | $A_{ks}{}^mC_{ks}A_{ks}G_{ds}U_{ys}{}^mC_{ds}T_{ds}T_{ds}A_{ds}A_{ds}A_{ds}{}^mC_{ds}{}^mC_{ds}T_{ks}T_{ks}{}^mC_k$ | 81 | 2866 |
| 1341656 | 1257 | 1272 | 21072 | 21087 | AGCTUTTGTCCACCTT | $A_{ks}G_{ks}{}^mC_{ks}T_{ds}U_{ys}T_{ds}T_{ds}G_{ds}T_{ds}{}^mC_{ds}{}^mC_{ds}A_{ds}{}^mC_{ds}{}^mC_{ks}T_{ks}T_k$ | 72 | 2867 |
| 1341657 | 613 | 628 | N/A | N/A | CTGGAACAATATGGGA | $^mC_{ks}T_{ks}G_{ds}G_{ds}A_{ys}A_{ds}{}^mC_{ds}A_{ds}A_{ds}T_{ds}A_{ds}T_{ds}G_{ds}G_{ds}G_{ks}A_k$ | 45 | 1969 |
| 1341659 | 1327 | 1342 | 21142 | 21157 | AATGCTACTTGAACAG | $A_{ks}A_{ks}T_{ks}G_{ds}C_{ys}T_{ds}A_{ds}{}^mC_{ds}T_{ds}T_{ds}G_{ds}A_{ds}A_{ds}{}^mC_{ks}A_{ks}G_k$ | 34 | 1045 |
| 1341662 | 1319 | 1334 | 21134 | 21149 | TTGAACAGTCTTAAAC | $T_{ks}T_{ks}G_{ks}A_{ds}A_{ys}{}^mC_{ds}A_{ds}G_{ds}T_{ds}{}^mC_{ds}T_{ds}T_{ds}A_{ds}A_{ks}A_{ks}{}^mC_k$ | 11 | 422 |
| 1341665 | 1310 | 1325 | 21125 | 21140 | CTTAAACCTTCCCTGT | $^mC_{ks}T_{ks}T_{ks}A_{ds}A_{ys}A_{ds}{}^mC_{ds}{}^mC_{ds}T_{ds}T_{ds}{}^mC_{ds}{}^mC_{ds}{}^mC_{ds}T_{ks}G_{ks}T_k$ | 24 | 1823 |
| 1341675 | 1323 | 1338 | 21138 | 21153 | CTACUTGAACAGTCTT | $^mC_{ks}T_{ks}A_{ks}{}^mC_{ds}U_{ys}T_{ds}G_{ds}A_{ds}A_{ds}{}^mC_{ds}A_{ds}G_{ds}T_{ds}{}^mC_{ks}T_{ks}T_k$ | 79 | 2868 |
| 1341679 | 1355 | 1370 | 21170 | 21185 | GATAUTCTGTGGCATG | $GsA_{ks}T_{ks}A_{ds}U_{ys}T_{ds}{}^mC_{ds}T_{ds}G_{ds}T_{ds}G_{ds}G_{ds}{}^mC_{ds}A_{ks}T_{ks}G_k$ | 60 | 2869 |
| 1341681 | 1337 | 1352 | 21152 | 21167 | TACAGATTGGAATGCT | $T_{ks}A_{ks}{}^mC_{ks}A_{ds}G_{ys}A_{ds}T_{ds}T_{ds}G_{ds}G_{ds}A_{ds}A_{ds}T_{ds}G_{ks}{}^mC_{ks}T_k$ | 60 | 1746 |
| 1341682 | 700 | 715 | 12118 | 12133 | CAGAGACATGAGGTTT | $^mC_{ks}A_{ks}G_{ks}A_{ds}G_{ys}A_{ds}{}^mC_{ds}A_{ds}T_{ds}G_{ds}A_{ds}G_{ds}G_{ds}T_{ks}T_{ks}T_k$ | 61 | 2319 |
| 1341684 | 1331 | 1346 | 21146 | 21161 | TTGGAATGCTACTTGA | $T_{ks}T_{ks}G_{ks}G_{ds}A_{ys}A_{ds}T_{ds}G_{ds}{}^mC_{ds}T_{ds}A_{ds}{}^mC_{ds}T_{ds}T_{ks}G_{ks}A_k$ | 65 | 1279 |
| 1341687 | 1346 | 1361 | 21161 | 21176 | TGGCATGGCTACAGAT | $T_{ks}G_{ks}G_{ks}{}^mC_{ds}A_{ys}T_{ds}G_{ds}G_{ds}{}^mC_{ds}T_{ds}A_{ds}{}^mC_{ds}A_{ds}G_{ks}A_{ks}T_k$ | 57 | 423 |
| 1341688 | 1359 | 1374 | 21174 | 21189 | TGTTGATATTCTGTGG | $T_{ks}G_{ks}T_{ks}T_{ds}G_{ys}A_{ds}T_{ds}A_{ds}T_{ds}T_{ds}{}^mC_{ds}T_{ds}G_{ds}TkSG_{ks}G_k$ | 48 | 1358 |
| 1341695 | 1351 | 1366 | 21166 | 21181 | TTCTGTGGCATGGCTA | $T_{ks}T_{ks}{}^mC_{ks}T_{ds}G_{ys}T_{ds}G_{ds}G_{ds}{}^mC_{ds}A_{ds}T_{ds}G_{ds}G_{ds}mG_{ks}T_{ks}A_k$ | 65 | 812 |
| 1341700 | 1384 | 1399 | 21199 | 21214 | TAGCUGTGCACTCATT | $T_{ks}A_{ks}G_{ks}{}^mC_{ds}U_{ys}G_{ds}T_{ds}G_{ds}{}^mC_{ds}A_{ds}{}^mC_{ds}T_{ds}{}^mC_{ds}A_{ks}T_{ks}T_k$ | 60 | 2870 |
| 1341704 | 1391 | 1406 | 21206 | 21221 | GATCUCTTAGCTGTGC | $G_{ks}A_{ks}T_{ks}{}^mC_{ds}U_{ys}{}^mC_{ds}T_{ds}T_{ds}A_{ds}G_{ds}{}^mC_{ds}T_{ds}G_{ds}T_{ks}G_{ks}{}^mC_k$ | 65 | 2871 |

TABLE 48-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341710 | 1419 | 1434 | 21234 | 21249 | GTTGAGATAAAGCTGC | $G_{ks}T_{ks}T_{ks}G_{ds}A_{ys}G_{ds}A_{ds}T_{ds}A_{ds}A_{ds}A_{ds}G_{ds}{}^mC_{ds}T_{ks}G_{ks}{}^mC_k$ | 51 | 1748 |
| 1341712 | 1423 | 1438 | 21238 | 21253 | CCAGGTTGAGATAAAG | ${}^mC_{ks}{}^mC_{ks}A_{ks}G_{ds}G_{ys}T_{ds}T_{ds}G_{ds}A_{ds}G_{ds}A_{ds}T_{ds}A_{ds}A_{ks}A_{ks}G_k$ | 49 | 33 |
| 1341715 | 1398 | 1413 | 21213 | 21228 | GAAACTTGATCTCTTA | $G_{ks}A_{ks}A_{ks}A_{ds}C_{ys}T_{ds}T_{ds}G_{ds}A_{ds}T_{ds}{}^mC_{ds}T_{ds}{}^mC_{ds}T_{ks}T_{ks}A_k$ | 59 | 2717 |
| 1341720 | 1496 | 1511 | 21311 | 21326 | GTTGCACCGTTTTGGG | $G_{ks}T_{ks}T_{ks}G_{ds}C_{ys}A_{ds}{}^mC_{ds}{}^mC_{ds}G_{ds}T_{ds}T_{ds}T_{ds}T_{ds}G_{ks}G_{ks}G_k$ | 38 | 1827 |
| 1341724 | 1431 | 1446 | 21246 | 21261 | AAATATGTCCAGGTTG | $A_{ks}A_{ks}A_{ks}T_{ds}A_{ys}T_{ds}G_{ds}T_{ds}{}^mC_{ds}{}^mC_{ds}A_{ds}G_{ds}G_{ds}T_{ks}T_{ks}G_k$ | 63 | 581 |
| 1341730 | 1488 | 1503 | 21303 | 21318 | GTTTGGGCTAATGAA | $G_{ks}T_{ks}T_{ks}T_{ds}U_{ys}G_{ds}G_{ds}G_{ds}{}^mC_{ds}T_{ds}A_{ds}A_{ds}T_{ds}G_{ks}A_{ks}A_k$ | 30 | 2872 |
| 1341732 | 801 | 816 | 15682 | 15697 | GTATUCCATCTATCAG | $G_{ks}T_{ks}A_{ks}T_{ds}U_{ys}{}^mC_{ds}{}^mC_{ds}A_{ds}T_{ds}{}^mC_{ds}T_{ds}A_{ds}T_{ds}{}^mC_{ks}A_{ks}G_k$ | 41 | 2873 |
| 1341735 | 1492 | 1507 | 21307 | 21322 | CACCGTTTTGGGCTAA | ${}^mC_{ks}A_{ks}{}^mC_{ks}{}^mC_{ds}G_{ys}T_{ds}T_{ds}T_{ds}T_{ds}G_{ds}G_{ds}G_{ds}{}^mC_{ds}T_{ks}A_{ks}A_k$ | 82 | 1516 |
| 1341746 | 1501 | 1516 | 21316 | 21331 | ATAGAGTTGCACCGTT | $A_{ks}T_{ks}A_{ks}G_{ds}A_{ys}G_{ds}T_{ds}T_{ds}G_{ds}{}^mC_{ds}A_{ds}{}^mC_{ds}{}^mC_{ds}G_{ks}T_{ks}T_k$ | 59 | 192 |
| 1341747 | 1602 | 1617 | 21417 | 21432 | ATGTATCTTATAAGAC | $A_{ks}T_{ks}G_{ks}T_{ds}A_{ys}T_{ds}{}^mC_{ds}T_{ds}T_{ds}A_{ds}T_{ds}A_{ds}A_{ds}G_{ks}A_{ks}{}^mC_k$ | 3 | 1751 |
| 1341749 | 1621 | 1636 | 21436 | 21451 | GAGTCGGTCACCTTTC | $G_{ks}A_{ks}G_{ks}T_{ds}C_{ys}G_{ds}G_{ds}T_{ds}{}^mC_{ds}A_{ds}{}^mC_{ds}{}^mC_{ds}T_{ks}T_{ks}{}^mC_k$ | 55 | 350 |
| 1341750 | 1625 | 1640 | 21440 | 21455 | AATAGAGTCGGTCACC | $A_{ks}A_{ks}T_{ks}A_{ds}G_{ys}A_{ds}G_{ds}T_{ds}{}^mC_{ds}G_{ds}G_{ds}T_{ds}{}^mC_{ds}A_{ks}{}^mC_{ks}{}^mC_k$ | 57 | 662 |
| 1341752 | 1617 | 1632 | 21432 | 21447 | CGGTCACCTTTCATAA | ${}^mC_{ks}G_{ks}G_{ks}T_{ds}C_{ys}A_{ds}{}^mC_{ds}{}^mC_{ds}T_{ds}T_{ds}T_{ds}{}^mC_{ds}A_{ds}T_{ks}A_{ks}A_k$ | 42 | 36 |
| 1341762 | 1713 | 1728 | 21528 | 21543 | AACAUCTCTGGGACCA | $A_{ks}A_{ks}{}^mC_{ks}A_{ds}U_{ys}{}^mC_{ds}T_{ds}{}^mC_{ds}T_{ds}G_{ds}G_{ds}G_{ds}A_{ds}{}^mC_{ks}{}^mC_{ks}A_k$ | 64 | 2874 |
| 1341766 | 1629 | 1644 | 21444 | 21459 | TTAAAATAGAGTCGGT | $T_{ks}T_{ks}A_{ks}A_{ds}A_{ys}A_{ds}T_{ds}A_{ds}G_{ds}A_{ds}G_{ds}T_{ds}{}^mC_{ds}G_{ks}G_{ks}T_k$ | 70 | 973 |
| 1341769 | 1726 | 1741 | 21541 | 21556 | CTAAAATTGTCTAAAC | ${}^mC_{ks}T_{ks}A_{ds}A_{ds}A_{ys}A_{ds}T_{ds}T_{ds}G_{ds}T_{ds}{}^mC_{ds}T_{ds}A_{ds}A_{ks}A_{ks}{}^mC_k$ | 13 | 2590 |
| 1341772 | 1717 | 1732 | 21532 | 21547 | TCTAAACATCTCTGGG | $T_{ks}{}^mC_{ks}T_{ks}A_{ds}A_{ys}A_{ds}{}^mC_{ds}A_{ds}T_{ds}{}^mC_{ds}T_{ds}{}^mC_{ds}T_{ds}G_{ks}G_{ks}G_k$ | 36 | 2287 |
| 1341775 | 1708 | 1723 | 21523 | 21538 | CTCTGGGACCAAGGAT | ${}^mC_{ks}T_{ks}{}^mC_{ks}T_{ds}G_{ys}G_{ds}G_{ds}A_{ds}{}^mC_{ds}{}^mC_{ds}A_{ds}A_{ds}G_{ds}G_{ks}A_{ks}T_k$ | 43 | 1908 |
| 1341778 | 1773 | 1788 | 21588 | 21603 | AATAGCCAGTACAGTT | $A_{ks}A_{ks}T_{ks}A_{ds}G_{ys}{}^mC_{ds}{}^mC_{ds}A_{ds}G_{ds}T_{ds}A_{ds}{}^mC_{ds}A_{ds}G_{ks}T_{ks}T_k$ | 66 | 118 |
| 1341782 | 1766 | 1781 | 21581 | 21596 | AGTACAGTTCCTTTC | $A_{ks}G_{ks}T_{ks}A_{ds}C_{ys}A_{ds}G_{ds}T_{ds}T_{ds}{}^mC_{ds}{}^mC_{ds}T_{ds}T_{ks}T_{ks}{}^mC_k$ | 56 | 1597 |
| 1341790 | 791 | 806 | 15672 | 15687 | TATCAGACTTCTTACG | $T_{ks}A_{ks}T_{ks}{}^mC_{ds}A_{ys}G_{ds}A_{ds}{}^mC_{ds}T_{ds}T_{ds}{}^mC_{ds}T_{ds}T_{ds}A_{ks}{}^mC_{ks}G_k$ | 27 | 103 |
| 1341794 | 1777 | 1792 | 21592 | 21607 | ATGTAATAGCCAGTAC | $A_{ks}T_{ks}G_{ks}T_{ds}A_{ys}A_{ds}T_{ds}A_{ds}G_{ds}{}^mC_{ds}{}^mC_{ds}A_{ds}G_{ds}T_{ks}A_{ks}{}^mC_k$ | 42 | 430 |
| 1341798 | 1781 | 1796 | 21596 | 21611 | TCTTATGTAATAGCCA | $T_{ks}{}^mC_{ks}T_{ks}T_{ds}A_{ys}T_{ds}G_{ds}T_{ds}A_{ds}A_{ds}T_{ds}A_{ds}G_{ds}{}^mC_{ks}{}^mC_{ks}A_k$ | 64 | 742 |
| 1341802 | 2191 | 2206 | 22006 | 22021 | GTCTUGATGTAGTGGG | $G_{ks}T_{ks}{}^mC_{ks}T_{ds}U_{ys}G_{ds}A_{ds}T_{ds}G_{ds}T_{ds}A_{ds}G_{ds}T_{ds}G_{ks}G_{ks}G_k$ | 63 | 2875 |

TABLE 48-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341803 | 2184 | 2199 | 21999 | 22014 | TGTAGTGGGAGTCGGA | $T_{ks}G_{ks}T_{ks}A_{ds}G_{ys}T_{ds}G_{ds}G_{ds}G_{ds}A_{ds}G_{ds}T_{ds}{}^mC_{ds}G_{ks}G_{ks}A_k$ | 50 | 587 |
| 1341811 | 2355 | 2370 | 22170 | 22185 | TTATAACTACAAGAGG | $T_{ks}T_{ks}A_{ks}T_{ds}A_{ys}A_{ds}{}^mC_{ds}T_{ds}A_{ds}{}^mC_{ds}A_{ds}A_{ds}G_{ds}A_{ks}G_{ks}G_k$ | 58 | 1289 |
| 1341812 | 812 | 827 | 15693 | 15708 | CTTAUTGGTAAGTATT | ${}^mC_{ks}T_{ks}T_{ks}A_{ds}U_{ys}T_{ds}G_{ds}G_{ds}T_{ds}A_{ds}A_{ds}G_{ds}T_{ds}A_{ks}T_{ks}T_k$ | 0 | 2876 |
| 1341814 | 2254 | 2269 | 22069 | 22084 | CAAGAGGATAGTCCAT | ${}^mC_{ks}A_{ks}A_{ks}G_{ds}A_{ys}G_{ds}G_{ds}A_{ds}T_{ds}A_{ds}G_{ds}T_{ds}{}^mC_{ds}{}^mC_{ks}A_{ks}T_k$ | 60 | 510 |
| 1341815 | 2245 | 2260 | 22060 | 22075 | AGTCCATGCAAAAGCA | $A_{ks}G_{ks}T_{ks}{}^mC_{ds}C_{ys}A_{ds}T_{ds}G_{ds}{}^mC_{ds}A_{ds}A_{ds}A_{ds}A_{ds}G_{ks}{}^mC_{ks}A_k$ | 73 | 120 |
| 1341819 | N/A | N/A | 9337 | 9352 | CCTCGATCCTATATAC | ${}^mC_{ks}{}^mC_{ks}T_{ks}{}^mC_{ds}G_{ys}A_{ds}T_{ds}{}^mC_{ds}mC_{ds}T_{ds}A_{ds}T_{ds}A_{ds}T_{ks}A_{ks}{}^mC_k$ | 9 | 2812 |
| 1341821 | N/A | N/A | 9518 | 9533 | CTACACTAATATTGAG | ${}^mC_{ks}T_{ks}A_{ks}{}^mC_{ds}A_{ys}{}^mC_{ds}T_{ds}A_{ds}A_{ds}T_{ds}A_{ds}T_{ds}T_{ds}G_{ks}A_{ks}G_k$ | 29 | 59 |
| 1341829 | N/A | N/A | 9961 | 9976 | TAAGCTGAGAGTTCTA | $T_{ks}A_{ks}A_{ks}G_{ds}C_{ys}T_{ds}G_{ds}A_{ds}G_{ds}A_{ds}G_{ds}T_{ds}T_{ds}{}^mC_{ks}T_{ks}A_k$ | 27 | 2499 |
| 1341834 | N/A | N/A | 9971 | 9986 | TTGAGTAGTGTAAGCT | $T_{ks}T_{ks}G_{ks}A_{ds}G_{ys}T_{ds}A_{ds}G_{ds}T_{ds}G_{ds}T_{ds}A_{ds}A_{ds}G_{ks}{}^mC_{ks}T_k$ | 35 | 2346 |
| 1341838 | 1022 | 1037 | 20837 | 20852 | CTTTGCAGCATTGATT | ${}^mC_{ks}T_{ks}T_{ks}T_{ds}G_{ys}{}^mC_{ds}A_{ds}G_{ds}{}^mC_{ds}A_{ds}T_{ds}T_{ds}G_{ds}A_{ks}T_{ks}T_k$ | 19 | 2463 |
| 1341841 | N/A | N/A | 11571 | 11586 | TCTTGACAATGGTTGA | $T_{ks}{}^mC_{ks}T_{ks}T_{ds}G_{ys}A_{ds}{}^mC_{ds}A_{ds}A_{ds}T_{ds}G_{ds}G_{ds}T_{ds}T_{ks}G_{ks}A_k$ | 56 | 2440 |
| 1341846 | N/A | N/A | 11855 | 11870 | TAAGCAGAATTGTGAA | $T_{ks}A_{ks}A_{ks}G_{ds}C_{ys}A_{ds}G_{ds}A_{ds}A_{ds}T_{ds}T_{ds}G_{ds}T_{ds}G_{ks}A_{ks}A_k$ | 26 | 2361 |
| 1341849 | N/A | N/A | 14194 | 14209 | TGTGATTGAGTTCTCC | $T_{ks}G_{ks}T_{ks}G_{ds}A_{ys}T_{ds}T_{ds}G_{ds}A_{ds}G_{ds}T_{ds}T_{ds}{}^mC_{ds}T_{ks}{}^mC_{ks}{}^mC_k$ | 34 | 2020 |
| 1341852 | N/A | N/A | 12423 | 12438 | GGTGGTAACGGTGATC | $G_{ks}G_{ks}T_{ks}G_{ds}G_{ys}T_{ds}A_{ds}A_{ds}{}^mC_{ds}G_{ds}G_{ds}T_{ds}G_{ds}A_{ks}T_{ks}{}^mC_k$ | 35 | 2591 |
| 1341857 | N/A | N/A | 14204 | 14219 | CAGAUTATTATGTGAT | ${}^mC_{ks}A_{ks}G_{ks}A_{ds}U_{ys}T_{ds}A_{ds}T_{ds}T_{ds}A_{ds}T_{ds}G_{ds}T_{ds}G_{ks}A_{ks}T_k$ | 32 | 2877 |
| 1341859 | N/A | N/A | 15491 | 15506 | TTAAUGCCACCCTACC | $T_{ks}T_{ks}A_{ks}A_{ds}U_{ys}G_{ds}{}^mC_{ds}{}^mC_{ds}A_{ds}{}^mC_{ds}{}^mC_{ds}{}^mC_{ds}T_{ds}A_{ks}{}^mC_{ks}{}^mC_k$ | 8 | 2878 |
| 1341868 | N/A | N/A | 16282 | 16297 | TAGTCTTCAGCAAAGT | $T_{ks}A_{ks}G_{ks}T_{ds}C_{ys}T_{ds}T_{ds}{}^mC_{ds}A_{ds}G_{ds}{}^mC_{ds}A_{ds}SA_{ks}G_{ks}T_k$ | 41 | 2632 |
| 1341874 | N/A | N/A | 16131 | 16146 | GCTCCATAATAATAGC | $G_{ks}{}^mC_{ks}T_{ks}{}^mC_{ds}C_{ys}A_{ds}T_{ds}A_{ds}A_{ds}T_{ds}A_{ds}A_{ds}T_{ds}A_{ks}G_{ks}{}^mC_k$ | 16 | 2665 |
| 1341880 | N/A | N/A | 17991 | 18006 | GTTAGTATAGTTATCT | $G_{ks}T_{ks}T_{ks}A_{ds}G_{ys}T_{ds}A_{ds}T_{ds}A_{ds}G_{ds}T_{ds}T_{ds}A_{ds}T_{ks}{}^mC_{ks}T_k$ | 52 | 1171 |
| 1341883 | N/A | N/A | 17996 | 18011 | ATGAAGTTAGTATAGT | $A_{ks}T_{ks}G_{ks}A_{ds}A_{ys}G_{ds}T_{ds}T_{ds}A_{ds}G_{ds}T_{ds}A_{ds}T_{ds}A_{ks}G_{ks}T_k$ | 38 | 1483 |
| 1341886 | N/A | N/A | 16377 | 16392 | ACCAAACTTCCAGCAG | $A_{ks}{}^mC_{ks}{}^mC_{ks}A_{ds}A_{ys}A_{ds}{}^mC_{ds}T_{ds}T_{ds}{}^mC_{ds}{}^mC_{ds}A_{ds}G_{ds}{}^mC_{ks}A_{ks}G_k$ | 54 | 1948 |
| 1341891 | N/A | N/A | 18097 | 18112 | GAAAUTGATACACCAA | $G_{ks}A_{ks}A_{ks}A_{ds}U_{ys}T_{ds}G_{ds}A_{ds}T_{ds}A_{ds}{}^mC_{ds}A_{ds}{}^mC_{ds}{}^mC_{ks}A_{ks}A_k$ | 58 | 2879 |
| 1341894 | N/A | N/A | 17986 | 18001 | TATAGTTATCTTCTCA | $T_{ks}A_{ks}T_{ks}A_{ds}G_{ys}T_{ds}T_{ds}A_{ds}T_{ds}{}^mC_{ds}T_{ds}T_{ds}{}^mC_{ds}T_{ks}{}^mC_{ks}A_k$ | 33 | 2295 |
| 1341899 | N/A | N/A | 18695 | 18710 | AAAGACTTTGAGACTC | $A_{ks}A_{ks}A_{ks}G_{ds}A_{ys}{}^mC_{ds}T_{ds}T_{ds}T_{ds}G_{ds}A_{ds}G_{ds}A_{ds}{}^mC_{ks}T_{ks}{}^mC_k$ | 76 | 1250 |

TABLE 48-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341901 | N/A | N/A | 19914 | 19929 | AGTGCATCTTAAGATA | $A_{ks}G_{ks}T_{ks}G_{ds}C_{ys}A_{ds}T_{ds}{}^{m}C_{ds}T_{ds}T_{ds}A_{ds}A_{ds}G_{ds}A_{ks}T_{ks}A_{k}$ | 17 | 2130 |
| 1341904 | 1081 | 1096 | 20896 | 20911 | CTGCUAGTGCCAAACC | ${}^{m}C_{ks}T_{ks}G_{ks}{}^{m}C_{ds}U_{ys}A_{ds}G_{ds}T_{ds}G_{ds}{}^{m}C_{ds}{}^{m}C_{ds}A_{ds}A_{ds}A_{ks}{}^{m}C_{ks}{}^{m}C_{k}$ | 67 | 2880 |
| 1341915 | N/A | N/A | 19906 | 19921 | TTAAGATACCCAGGTT | $T_{ks}T_{ks}A_{ks}A_{ds}G_{ys}A_{ds}T_{ds}A_{ds}{}^{m}C_{ds}{}^{m}C_{ds}{}^{m}C_{ds}A_{ds}G_{ds}G_{ks}T_{ks}T_{k}$ | 30 | 163 |
| 1341917 | N/A | N/A | 19910 | 19925 | CATCUTAAGATACCCA | ${}^{m}C_{ks}A_{ks}T_{ks}{}^{m}C_{ds}U_{ys}T_{ds}A_{ds}A_{ds}G_{ds}A_{ds}T_{ds}A_{ds}{}^{m}C_{ds}{}^{m}C_{ks}{}^{m}C_{ks}A_{k}$ | 56 | 2881 |
| 1341921 | N/A | N/A | 20116 | 20131 | CAGCATCAAGACATTC | ${}^{m}C_{ks}A_{ks}G_{ks}{}^{m}C_{ds}A_{ys}T_{ds}{}^{m}C_{ds}A_{ds}A_{ds}G_{ds}A_{ds}{}^{m}C_{ds}A_{ds}T_{ks}T_{ks}{}^{m}C_{k}$ | 52 | 2191 |
| 1341925 | N/A | N/A | 20009 | 20024 | AGAGAGTAATCAGTTT | $A_{ks}G_{ks}A_{ks}G_{ds}A_{ys}G_{ds}T_{ds}A_{ds}A_{ds}T_{ds}{}^{m}C_{ds}A_{ds}G_{ds}T_{ks}T_{ks}T_{k}$ | 25 | 2651 |
| 1341934 | N/A | N/A | 20192 | 20207 | GCAGUTATTAGAAGTC | $G_{ks}{}^{m}C_{ks}A_{ks}G_{ds}U_{ys}T_{ds}A_{ds}T_{ds}T_{ds}A_{ds}G_{ds}A_{ds}A_{ds}G_{ks}T_{ks}{}^{m}C_{k}$ | 59 | 2882 |
| 1341937 | 1077 | 1092 | 20892 | 20907 | TAGTGCCAAACCAATG | $T_{ks}A_{ks}G_{ks}T_{ds}G_{ys}{}^{m}C_{ds}{}^{m}C_{ds}A_{ds}A_{ds}A_{ds}{}^{m}C_{ds}{}^{m}C_{ds}A_{ds}A_{ks}T_{ks}G_{k}$ | 55 | 1198 |
| 1341939 | 1085 | 1100 | 20900 | 20915 | ACTGCTGCTAGTGCCA | $A_{ks}{}^{m}C_{ks}T_{ks}G_{ds}C_{ys}T_{ds}G_{ds}{}^{m}C_{ds}T_{ds}A_{ds}G_{ds}T_{ds}G_{ds}{}^{m}C_{ks}{}^{m}C_{ks}A_{k}$ | 64 | 1821 |
| 1341943 | N/A | N/A | 20486 | 20501 | AACTUCATAGTGGACT | $A_{ks}A_{ks}{}^{m}C_{ks}T_{ds}U_{ys}{}^{m}C_{ds}A_{ds}T_{ds}A_{ds}G_{ds}T_{ds}G_{ds}G_{ds}A_{ks}{}^{m}C_{ks}T_{k}$ | 38 | 2883 |
| 1341945 | N/A | N/A | 20422 | 20437 | ACAGUAAAATTATGCC | $A_{ks}{}^{m}C_{ks}A_{ks}G_{ds}U_{ys}A_{ds}A_{ds}A_{ds}A_{ds}T_{ds}T_{ds}A_{ds}T_{ds}G_{ks}{}^{m}C_{ks}{}^{m}C_{k}$ | 24 | 2884 |
| 1341947 | N/A | N/A | 20381 | 20396 | AATCACAAGTAAGGTA | $A_{ks}A_{ks}T_{ks}{}^{m}C_{ds}A_{ys}mC_{ds}A_{ds}A_{ds}G_{ds}T_{ds}A_{ds}A_{ds}G_{ds}G_{ks}T_{ks}A_{k}$ | 31 | 1333 |
| 1341954 | N/A | N/A | 12501 | 12516 | GCAGAAATTCACCTTG | $G_{ks}{}^{m}C_{ks}A_{ks}G_{ds}A_{ys}A_{ds}A_{ds}T_{ds}T_{ds}{}^{m}C_{ds}A_{ds}{}^{m}C_{ds}{}^{m}C_{ds}T_{ks}T_{ks}G_{k}$ | 54 | 1002 |

TABLE 49

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^{m}C_{ks}A_{k}$ | 86 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^{m}C_{ds}A_{ds}T_{ds}T_{ds}{}^{m}C_{ds}A_{ks}G_{ks}T_{k}$ | 82 | 1526 |
| 1341508 | N/A | N/A | 14189 | 14204 | TTGAGTTCTCCACTGC | $T_{ks}T_{ks}G_{ks}A_{ds}G_{ds}T_{ds}T_{ds}{}^{m}C_{ds}T_{ds}{}^{m}C_{ds}{}^{m}C_{ds}A_{ds}{}^{m}C_{ks}T_{ks}G_{ks}{}^{m}C_{e}$ | 26 | 2885 |
| 1341518 | 1251 | 1266 | 21066 | 21081 | TGTCCACCTTTAAATG | $T_{ks}G_{ks}T_{ks}{}^{m}C_{ds}{}^{m}C_{ds}A_{ds}{}^{m}C_{ds}{}^{m}C_{ds}T_{ds}T_{ds}T_{ds}A_{ds}A_{ks}A_{ks}T_{k}gG_{e}$ | 28 | 1666 |
| 1341519 | 1310 | 1325 | 21125 | 21140 | CTTAAACCTTCCCTGT | ${}^{m}C_{ks}T_{ks}T_{ks}A_{ds}A_{ds}A_{ds}{}^{m}C_{ds}{}^{m}C_{ds}T_{ds}T_{ds}{}^{m}C_{ds}{}^{m}C_{ds}{}^{m}C_{ks}T_{ks}G_{ks}T_{e}$ | 34 | 1823 |
| 1341520 | 1328 | 1343 | 21143 | 21158 | GAATGCTACTTGAACA | $G_{ks}A_{ks}A_{ks}T_{ds}G_{ds}{}^{m}C_{ds}T_{ds}A_{ds}{}^{m}C_{ds}T_{ds}T_{ds}G_{ds}A_{ds}A_{ks}{}^{m}C_{ks}A_{e}$ | 56 | 1123 |
| 1341521 | 1330 | 1345 | 21145 | 21160 | TGGAATGCTACTTGAA | $T_{ks}G_{ks}G_{ks}A_{ds}A_{ds}T_{ds}G_{ds}{}^{m}C_{ds}T_{ds}A_{ds}{}^{m}C_{ds}T_{ds}T_{ks}G_{ks}A_{ks}A_{e}$ | 57 | 2203 |

TABLE 49-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341522 | 1320 | 1335 | 21135 | 21150 | CTTGAACAGTCTTAAA | $^mC_{ks}T_{ks}T_{ks}G_{ds}A_{ds}A_{ds}{}^mC_{ds}A_{ds}G_{ds}T_{ds}{}^mC_{ds}T_{ds}T_{ks}A_{ks}A_e$ | 43 | 500 |
| 1341523 | 1309 | 1324 | 21124 | 21139 | TTAAACCTTCCCTGTG | $T_{ks}T_{ks}A_{ds}A_{ds}A_{ds}{}^mC_{ds}{}^mC_{ds}T_{ds}T_{ds}{}^mC_{ds}{}^mC_{ds}{}^mC_{ds}T_{ks}G_{ks}T_{ks}G_e$ | 18 | 2807 |
| 1341524 | 1319 | 1334 | 21134 | 21149 | TTGAACAGTCTTAAAC | $T_{ks}T_{ks}G_{ks}A_{ds}A_{ds}{}^mC_{ds}A_{ds}G_{ds}T_{ds}{}^mC_{ds}T_{ds}T_{ds}A_{ks}A_{ks}{}^mC_e$ | 35 | 422 |
| 1341525 | 1264 | 1279 | 21079 | 21094 | GGGAGGTAGCTTTTGT | $G_{ks}G_{ks}G_{ds}A_{ds}G_{ds}G_{ds}T_{ds}A_{ds}G_{ds}{}^mC_{ds}T_{ds}T_{ds}T_{ks}T_{ks}G_{ks}T_e$ | 40 | 343 |
| 1341526 | 1308 | 1323 | 21123 | 21138 | TAAACCTTCCCTGTGT | $T_{ks}A_{ks}A_{ks}A_{ds}{}^mC_{ds}{}^mC_{ds}T_{ds}T_{ds}{}^mC_{ds}{}^mC_{ds}{}^mC_{ds}T_{ds}G_{ks}T_{ks}G_{ks}T_e$ | 23 | 1745 |
| 1341527 | 1175 | 1190 | 20990 | 21005 | TAAGAGGCATGAAAGG | $T_{ks}A_{ks}A_{ks}G_{ds}A_{ds}G_{ds}G_{ds}{}^mC_{ds}A_{ds}T_{ds}G_{ds}A_{ds}A_{ks}A_{ks}G_{ks}G_e$ | 36 | 2751 |
| 1341530 | 693 | 708 | 12111 | 12126 | ATGAGGTTTTGATACC | $A_{ks}T_{ks}G_{ks}A_{ds}G_{ds}G_{ds}T_{ds}T_{ds}T_{ds}T_{ds}G_{ds}A_{ds}T_{ks}A_{ks}{}^mC_{ks}{}^mC_e$ | 20 | 569 |
| 1341531 | 1336 | 1351 | 21151 | 21166 | ACAGATTGGAATGCTA | $A_{ks}{}^mC_{ks}A_{ks}G_{ds}A_{ds}T_{ds}T_{ds}G_{ds}G_{ds}A_{ds}A_{ds}T_{ds}G_{ks}{}^mC_{ks}T_{ks}A_e$ | 68 | 1668 |
| 1341557 | 1347 | 1362 | 21162 | 21177 | GTGGCATGGCTACAGA | $G_{ks}T_{ks}G_{ks}G_{ds}{}^mC_{ds}A_{ds}T_{ds}G_{ds}G_{ds}{}^mC_{ds}T_{ds}A_{ds}{}^mC_{ks}A_{ks}G_{ks}A_e$ | 38 | 501 |
| 1341561 | 1346 | 1361 | 21161 | 21176 | TGGCATGGCTACAGAT | $T_{ks}G_{ks}G_{ks}{}^mC_{ds}A_{ds}T_{ds}G_{ds}G_{ds}{}^mC_{ds}T_{ds}A_{ds}{}^mC_{ds}A_{ks}G_{ks}A_{ks}T_e$ | 68 | 423 |
| 1341573 | 1348 | 1363 | 21163 | 21178 | TGTGGCATGGCTACAG | $T_{ks}G_{ks}T_{ks}G_{ds}G_{ds}{}^mC_{ds}A_{ds}T_{ds}G_{ds}G_{ds}{}^mC_{ds}T_{ds}A_{ks}{}^mC_{ks}A_{ks}G_e$ | 25 | 579 |
| 1341576 | 801 | 816 | 15682 | 15697 | GTATTCCATCTATCAG | $G_{ks}T_{ks}A_{ks}T_{ds}T_{ds}{}^mC_{ds}{}^mC_{ds}A_{ds}T_{ds}{}^mC_{ds}T_{ds}A_{ds}T_{ks}{}^mC_{ks}A_{ks}G_e$ | 51 | 727 |
| 1341608 | N/A | N/A | 19914 | 19929 | AGTGCATCTTAAGATA | $A_{ks}G_{ks}T_{ds}G_{ds}{}^mC_{ds}A_{ds}T_{ds}{}^mC_{ds}T_{ds}T_{ds}A_{ds}A_{ks}G_{es}A_{ks}T_{es}A_k$ | 27 | 2130 |
| 1341610 | N/A | N/A | 19915 | 19930 | GAGTGCATCTTAAGAT | $G_{ks}A_{ks}G_{ds}T_{dS}G_{ds}{}^mC_{ds}A_{ds}T_{ds}{}^mC_{ds}T_{ds}T_{ds}A_{ks}A_{es}G_{ks}A_{es}T_k$ | 27 | 2256 |
| 1341611 | N/A | N/A | 18690 | 18705 | CTTTGAGACTCTTGTT | $^mC_{ks}T_{ks}T_{ds}T_{ds}G_{ds}A_{dS}G_{ds}A_{ds}{}^mC_{ds}T_{ds}{}^mC_{ds}T_{ks}T_{es}G_{ks}T_{es}T_k$ | 42 | 2583 |
| 1341612 | N/A | N/A | 19904 | 19919 | AAGATACCCAGGTTGC | $A_{ks}A_{ks}G_{ds}A_{ds}T_{ds}A_{ds}{}^mC_{ds}{}^mC_{ds}{}^mC_{ds}A_{ds}G_{ds}G_{ks}T_{es}T_{ks}G_{es}{}^mC_k$ | 59 | 2712 |
| 1341613 | N/A | N/A | 18092 | 18107 | TGATACACCAATGCAG | $T_{ks}G_{ks}A_{ds}T_{ds}A_{ds}{}^mC_{ds}A_{ds}{}^mC_{ds}{}^mC_{ds}A_{ds}A_{ds}T_{ks}G_{es}{}^mC_{ks}A_{es}G_k$ | 62 | 2370 |
| 1341618 | N/A | N/A | 19906 | 19921 | TTAAGATACCCAGGTT | $T_{ks}T_{ks}A_{ds}A_{ds}G_{ds}A_{ds}T_cs A_{ds}{}^mC_{ds}{}^mC_{ds}{}^mC_{ds}A_{ks}G_{es}G_{ks}T_{es}T_k$ | 48 | 163 |
| 1341619 | N/A | N/A | 20388 | 20403 | CTATAGTAATCACAAG | $^mC_{ks}T_{ks}A_{ds}T_{ds}A_{ds}G_{ds}T_{ds}A_{ds}A_{ds}T_{ds}{}^mC_{ks}{}^mC_{es}A_{ks}A_{es}G_k$ | 36 | 1644 |
| 1341620 | N/A | N/A | 20187 | 20202 | TATTAGAAGTCAGCCC | $T_{ks}A_{ks}T_{ds}T_{ds}A_{ds}G_{ds}A_{ds}A_{ds}G_{ds}T_{ds}{}^mC_{ds}A_{ks}G_{es}{}^mC_{ks}{}^mC_{es}{}^mC_k$ | 36 | 164 |
| 1341621 | N/A | N/A | 20109 | 20124 | AAGACATTCTAGCCTG | $A_{ks}A_{ks}G_{ds}A_{ds}{}^mC_{ds}A_{dS}T_{dS}T_{ds}{}^mC_{ds}T_{ds}A_{ds}G_{ks}{}^mC_{es}{}^mC_{ks}T_{es}G_k$ | 25 | 2744 |
| 1341622 | N/A | N/A | 20197 | 20212 | ACATTGCAGTTATTAG | $A_{ks}{}^mC_{ks}A_{ds}T_{ds}T_{ds}G_{ds}{}^mC_{ds}A_{ds}G_{ds}T_{ds}T_{ks}A_{es}T_{ks}A_{es}G_k$ | 46 | 2309 |
| 1341623 | N/A | N/A | 20119 | 20134 | TTACAGCATCAAGACA | $T_{ks}T_{ks}A_{ds}{}^mC_{ds}A_{ds}G_{ds}{}^mC_{ds}A_{ds}T_{ds}{}^mC_{ds}A_{ds}A_{ks}G_{es}A_{ks}{}^mC_{es}A_k$ | 22 | 2409 |
| 1341624 | N/A | N/A | 19916 | 19931 | GGAGTGCATCTTAAGA | $G_{ks}G_{ks}A_{ds}G_{ds}T_{ds}G_{ds}{}^mC_{ds}A_{ds}T_{ds}{}^mC_{ds}T_{ks}T_{ks}A_{es}A_{ks}G_{es}A_k$ | 34 | 2810 |

TABLE 49-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341625 | N/A | N/A | 20009 | 20024 | AGAGAGTAATCAGTTT | $A_{ks}G_{ks}A_{ds}G_{ds}A_{ds}G_{ds}T_{ds}A_{ds}A_{ds}T_{ds}{}^mC_{ds}A_{ks}G_{es}T_{ks}T_{es}T_k$ | 52 | 2651 |
| 1341626 | N/A | N/A | 19905 | 19920 | TAAGATACCCAGGTTG | $T_{ks}A_{ds}G_{ds}A_{ds}T_{ds}A_{ds}{}^mC_{ds}{}^mC_{ds}{}^mC_{ds}A_{ds}G_{ks}G_{es}T_{ks}T_{es}G_k$ | 30 | 2790 |
| 1341627 | N/A | N/A | 19999 | 20014 | CAGTTTTCCTCATGAT | ${}^mC_{ks}A_{ds}G_{ds}T_{ds}T_{ds}T_{ds}T_{ds}{}^mC_{ds}{}^mC_{ds}T_{ds}{}^mC_{ds}A_{ks}T_{es}G_{ks}A_{es}T_k$ | 59 | 2331 |
| 1341628 | N/A | N/A | 20378 | 20393 | CACAAGTAAGGTAAAG | ${}^mC_{ks}A_{ks}{}^mC_{dS}A_{dS}A_{ds}G_{ds}T_{ds}A_{ds}A_{ds}G_{ds}G_{ds}T_{ks}A_{es}A_{ks}A_{es}G_k$ | 38 | 2448 |
| 1341629 | N/A | N/A | 12804 | 12819 | CTCAGGCTGTAAGAGT | ${}^mC_{ks}T_{kS}{}^mC_{ds}A_{dS}G_{ds}G_{ds}{}^mC_{ds}T_{ds}G_{ds}T_{ds}A_{ds}A_{ks}G_{cs}A_{ks}G_{es}T_k$ | 10 | 2240 |
| 1341630 | N/A | N/A | 14165 | 14180 | GCAAGCCAACAGAGAG | $G_{ks}{}^mC_{ks}A_{ds}A_{ds}G_{ds}{}^mC_{ds}{}^mC_{ds}A_{ds}A_{ds}{}^mC_{ds}A_{ds}G_{ks}A_{es}G_{ks}A_{es}G_k$ | 12 | 2556 |
| 1341631 | N/A | N/A | 14175 | 14190 | GCCTTGAATAGCAAGC | $G_{ks}{}^mC_{ks}{}^mC_{ds}T_{ds}T_{ds}G_{ds}A_{ds}A_{ds}T_{ds}A_{ds}G_{ds}{}^mC_{ks}A_{es}A_{ks}G_{es}{}^mC_k$ | 16 | 2063 |
| 1341632 | N/A | N/A | 13959 | 13974 | GTCTACCTCTAAGTTA | $G_{ks}T_{ks}{}^mC_{ds}T_{ds}A_{ds}{}^mC_{ds}{}^mC_{ds}T_{ds}{}^mC_{ds}T_{ds}A_{ds}A_{ks}G_{es}T_{ks}T_{es}A_k$ | 15 | 2363 |
| 1341633 | N/A | N/A | 13949 | 13964 | AAGTTAGCCCCCAGGA | $A_{ks}A_{ks}G_{ds}T_{ds}T_{ds}A_{ds}G_{ds}{}^mC_{ds}{}^mC_{ds}{}^mC_{ds}{}^mC_{ds}{}^mC_{ks}A_{es}G_{ks}G_{es}A_k$ | 12 | 2811 |
| 1341634 | N/A | N/A | 12496 | 12511 | AATTCACCTTGACTAA | $A_{ks}A_{ks}T_{ds}T_{ds}{}^mC_{ds}A_{ds}{}^mC_{ds}{}^mC_{ds}T_{ds}T_{ds}G_{ds}A_{ks}{}^mC_{es}T_{ks}A_{es}A_k$ | 9 | 2144 |
| 1341635 | N/A | N/A | 20479 | 20494 | TAGTGGACTTCATTAG | $T_{ks}A_{ds}G_{ds}T_{ds}G_{ds}G_{ds}A_{ds}{}^mC_{dS}T_{ds}T_{ds}{}^mC_{ds}A_{ks}T_{es}T_{ks}A_{es}G_k$ | 41 | 2351 |
| 1341636 | N/A | N/A | 20489 | 20504 | CATAACTTCATAGTGG | ${}^mC_{ks}A_{ds}T_{ds}A_{ds}A_{ds}{}^mC_{ds}T_{ds}T_{ds}{}^mC_{ds}A_{ds}T_{ds}A_{ks}G_{es}T_{ks}G_{es}G_k$ | 15 | 866 |
| 1341637 | N/A | N/A | 12794 | 12809 | AAGAGTCAGTATCCTC | $A_{ks}A_{ds}G_{ds}A_{ds}G_{ds}T_{ds}{}^mC_{ds}A_{ds}G_{ds}T_{ds}A_{ds}T_{ks}{}^mC_{es}{}^mC_{ks}T_{es}{}^mC_k$ | 14 | 2572 |
| 1341638 | 1394 | 1409 | 21209 | 21224 | CTTGATCTCTTAGCTG | ${}^mC_{ks}T_{kS}T_{ks}G_{ds}A_{ds}T_{ds}{}^mC_{ds}T_{ds}{}^mC_{ds}T_{ds}T_{ds}A_{ds}G_{ks}{}^mC_{ks}T_{ks}G_e$ | 36 | 736 |
| 1341639 | 1416 | 1431 | 21231 | 21246 | GAGATAAAGCTGCCTG | $G_{ks}A_{ks}G_{ks}A_{dS}T_{ds}A_{ds}A_{ds}A_{ds}G_{ds}{}^mC_{ds}T_{ds}G_{ds}{}^mC_{ks}{}^mC_{ks}T_{ks}G_e$ | 55 | 1592 |
| 1341640 | 1426 | 1441 | 21241 | 21256 | TGTCCAGGTTGAGATA | $T_{ks}G_{ks}T_{ks}{}^mC_{ds}{}^mC_{ds}A_{ds}G_{ds}G_{ds}T_{ds}T_{ds}G_{ds}A_{ds}G_{ks}A_{ks}T_{ks}A_e$ | 45 | 191 |
| 1341641 | 1415 | 1430 | 21230 | 21245 | AGATAAAGCTGCCTGC | $A_{ks}G_{ks}A_{ks}T_{ds}A_{ds}A_{ds}A_{ds}G_{ds}{}^mC_{ds}T_{ds}G_{ds}{}^mC_{ds}{}^mC_{ks}T_{ks}G_{ks}{}^mC_e$ | 44 | 1515 |
| 1341642 | 1425 | 1440 | 21240 | 21255 | GTCCAGGTTGAGATAA | $G_{ks}T_{kS}{}^mC_{ks}{}^mC_{ds}A_{ds}G_{ds}G_{ds}T_{ds}T_{ds}G_{ds}A_{ds}G_{ds}A_{ks}T_{ks}A_{ks}A_e$ | 52 | 113 |
| 1341643 | 791 | 806 | 15672 | 15687 | TATCAGACTTCTTACG | $T_{ks}A_{ks}T_{ks}{}^mC_{ds}A_{ds}G_{ds}A_{ds}{}^mC_{ds}T_{ds}T_{ds}{}^mC_{ds}T_{ds}T_{ks}A_{ks}{}^mC_{ks}G_e$ | 28 | 103 |
| 1341644 | 1398 | 1413 | 21213 | 21228 | GAAACTTGATCTCTTA | $G_{ks}A_{ks}A_{ks}A_{ds}{}^mC_{ds}T_{ds}T_{ds}G_{ds}A_{ds}T_{ds}{}^mC_{ds}T_{ds}{}^mC_{ks}T_{ks}T_{ks}A_e$ | 79 | 2717 |
| 1341645 | 1388 | 1403 | 21203 | 21218 | CTCTTAGCTGTGCACT | ${}^mC_{ks}T_{ks}{}^mC_{ks}T_{ds}T_{ds}A_{ds}G_{ds}{}^mC_{ds}T_{ds}G_{ds}T_{ds}G_{ds}{}^mC_{ks}A_{ks}{}^mC_{ks}T_e$ | 66 | 268 |
| 1341646 | 1384 | 1399 | 21199 | 21214 | TAGCTGTGCACTCATT | $T_{ks}A_{ks}G_{ks}{}^mC_{ds}T_{ds}G_{ds}T_{ds}G_{ds}{}^mC_{ds}A_{ds}{}^mC_{ds}T_{ds}{}^mC_{ks}A_{ks}T_{ks}T_e$ | 66 | 1981 |
| 1341647 | N/A | N/A | 14189 | 14204 | TTGAGTTCTCCACTGC | $T_{ks}T_{ks}G_{ds}A_{ds}G_{ds}T_{ds}T_{ds}{}^mC_{ds}T_{ds}{}^mC_{ds}{}^mC_{ds}A_{ks}{}^mC_{es}T_{ks}G_{es}{}^mC_k$ | 20 | 2885 |
| 1341949 | N/A | N/A | 12799 | 12814 | GCTGUAAGAGTCAGTA | $G_{ks}{}^mC_{ks}T_{ks}G_{ds}U_{ys}A_{ds}A_{ds}G_{ds}A_{ds}G_{ds}T_{ds}{}^mC_{ds}A_{ds}G_{ks}T_{ks}A_k$ | 28 | 2886 |

TABLE 49-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341950 | 1088 | 1103 | 20903 | 20918 | TTGACTGCTGCTAGTG | $T_{ks}T_{ks}G_{ks}A_{ds}C_{ys}T_{ds}G_{ds}{}^mC_{ds}T_{ds}G_{ds}{}^mC_{ds}T_{ds}A_{ds}G_{ks}T_{ks}G_k$ | 40 | 28 |
| 1341958 | N/A | N/A | 12797 | 12812 | TGTAAGAGTCAGTATC | $T_{ks}G_{ks}T_{ks}A_{ds}A_{ys}G_{ds}A_{ds}G_{ds}T_{ds}{}^mC_{ds}A_{ds}G_{ds}T_{ds}A_{ks}T_{ks}{}^mC_k$ | 29 | 2652 |
| 1341959 | 1091 | 1106 | 20906 | 20921 | CGTTUGACTGCTGCTA | ${}^mC_{ks}G_{ks}T_{ks}T_{ds}U_{ys}G_{ds}A_{ds}{}^mC_{ds}T_{ds}G_{ds}{}^mC_{ds}T_{ds}G_{ds}{}^mC_{ks}T_{ks}A_k$ | 54 | 2887 |
| 1341960 | N/A | N/A | 14172 | 14187 | TTGAATAGCAAGCCAA | $T_{ks}T_{ks}G_{ks}A_{ds}A_{ys}T_{ds}A_{ds}G_{ds}{}^mC_{ds}A_{ds}A_{ds}G_{ds}{}^mC_{ds}{}^mC_{ks}A_{ks}A_k$ | 30 | 1864 |
| 1341961 | N/A | N/A | 14175 | 14190 | GCCTUGAATAGCAAGC | $G_{ks}{}^mC_{ks}{}^mC_{ks}T_{ds}U_{ys}G_{ds}A_{ds}A_{ds}T_{ds}A_{ds}G_{ds}{}^mC_{ds}A_{ds}A_{ks}G_{ks}{}^mC_k$ | 12 | 2888 |
| 1341962 | N/A | N/A | 13949 | 13964 | AAGTUAGCCCCCAGGA | $A_{ks}A_{ks}G_{ks}T_{ds}U_{ys}A_{ds}G_{ds}{}^mC_{ds}{}^mC_{ds}{}^mC_{ds}{}^mC_{ds}{}^mC_{ds}A_{ds}G_{ks}G_{ks}A_k$ | 0 | 2889 |
| 1341963 | N/A | N/A | 13952 | 13967 | TCTAAGTTAGCCCCCA | $T_{ks}{}^mC_{ks}T_{ks}A_{ds}A_{ys}G_{ds}T_{d}gT_{ds}A_{ds}G_{ds}{}^mC_{ds}{}^mC_{ds}{}^mC_{ds}{}^mC_{ds}{}^mC_{ks}A_k$ | 7 | 928 |
| 1341964 | N/A | N/A | 13956 | 13971 | TACCUCTAAGTTAGCC | $T_{ks}A_{ks}T_{ks}{}^mC_{ds}U_{ys}{}^mC_{ds}T_{ds}A_{ds}A_{ds}G_{ds}T_{ds}T_{ds}A_{ds}G_{ks}{}^mC_{ks}{}^mC_k$ | 13 | 2890 |
| 1341965 | N/A | N/A | 13954 | 13969 | CCTCUAAGTTAGCCCC | ${}^mC_{ks}{}^mC_{ks}T_{ks}{}^mC_{ds}U_{ys}A_{ds}A_{ds}G_{ds}T_{ds}T_{ds}A_{ds}G_{ds}{}^mC_{ds}{}^mC_{ks}{}^mC_{ks}{}^mC_k$ | 8 | 2891 |
| 1341966 | N/A | N/A | 13959 | 13974 | GTCTACCTCTAAGTTA | $G_{ks}T_{ks}{}^mC_{ks}T_{ds}A_{ys}{}^mC_{ds}{}^mC_{ds}T_{ds}{}^mC_{ds}T_{ds}A_{ds}A_{ds}G_{ds}T_{ks}T_{ks}A_k$ | 15 | 2363 |
| 1341967 | N/A | N/A | 12794 | 12809 | AAGAGTCAGTATCCTC | $A_{ks}A_{ks}G_{ks}A_{ds}G_{vs}T_{ds}{}^mC_{ds}A_{ds}G_{ds}T_{ds}A_{ds}T_{ds}{}^mC_{ds}{}^mC_{ks}T_{ks}{}^mC_k$ | 55 | 2572 |
| 1341968 | 1202 | 1217 | 21017 | 21032 | GTATGTTTATGTAAGC | $G_{ks}T_{ks}A_{ks}T_{ds}G_{ys}T_{ds}T_{ds}T_{ds}A_{ds}T_{ds}G_{ds}T_{ds}A_{ds}A_{ks}G_{ks}{}^mC_k$ | 66 | 1511 |
| 1341969 | 1200 | 1215 | 21015 | 21030 | ATGTUTATGTAAGCAC | $A_{ks}T_{ks}G_{ks}T_{ds}U_{ys}T_{ds}A_{ds}T_{ds}G_{ds}T_{ds}A_{ds}A_{ds}G_{ds}{}^mC_{ks}A_{ks}{}^mC_k$ | 45 | 2892 |
| 1341970 | N/A | N/A | 14168 | 14183 | ATAGCAAGCCAACAGA | $A_{ks}T_{ks}A_{ks}G_{ds}C_{ys}A_{ds}A_{ds}G_{ds}{}^mC_{ds}{}^mC_{ds}A_{ds}A_{ds}{}^mC_{ds}A_{ks}G_{ks}A_k$ | 1 | 2633 |
| 1341971 | 606 | 621 | 10492 | 10507 | AATAUGGGATGAGGTA | $A_{ks}A_{ks}T_{ks}A_{ds}U_{ys}G_{ds}G_{ds}G_{ds}A_{ds}T_{ds}G_{ds}A_{ds}G_{ds}G_{ks}T_{ks}A_k$ | 38 | 2893 |
| 1341972 | 1175 | 1190 | 20990 | 21005 | TAAGAGGCATGAAAGG | $T_{ks}A_{ks}A_{ks}G_{ds}A_{ys}G_{ds}G_{ds}{}^mC_{ds}A_{ds}T_{ds}G_{ds}A_{ds}A_{ds}A_{ks}G_{ks}G_k$ | 50 | 2751 |
| 1341973 | 1180 | 1195 | 20995 | 21010 | GTTTUTAAGAGGCATG | $G_{ks}T_{ks}T_{ks}T_{ds}U_{ys}T_{ds}A_{ds}A_{ds}G_{ds}A_{ds}G_{ds}G_{ds}{}^mC_{ds}A_{ks}T_{ks}G_k$ | 38 | 2894 |
| 1341974 | N/A | N/A | 14165 | 14180 | GCAAGCCAACAGAGAG | $G_{ks}{}^mC_{ks}A_{ks}A_{ds}G_{ys}{}^mC_{ds}{}^mC_{ds}A_{ds}A_{ds}{}^mC_{ds}A_{ds}G_{ds}A_{ds}G_{ks}A_{ks}G_k$ | 26 | 2556 |
| 1341975 | N/A | N/A | 14170 | 14185 | GAATAGCAAGCCAACA | $G_{ks}A_{ks}A_{ks}T_{ds}A_{ys}G_{ds}{}^mC_{ds}A_{ds}A_{ds}G_{ds}{}^mC_{ds}{}^mC_{ds}A_{ds}A_{ks}{}^mC_{ks}A_k$ | 23 | 1708 |
| 1341976 | N/A | N/A | 14192 | 14207 | TGATUGAGTTCTCCAC | $T_{ks}G_{ks}A_{ks}T_{ds}U_{ys}G_{ds}A_{ds}G_{ds}T_{ds}T_{ds}{}^mC_{ds}T_{ds}{}^mC_{ds}{}^mC_{ks}A_{ks}{}^mC_k$ | 4 | 2895 |
| 1341977 | N/A | N/A | 14189 | 14204 | TTGAGTTCTCCACTGC | $T_{ks}T_{ks}G_{ks}A_{ds}G_{ys}T_{ds}T_{ds}{}^mC_{ds}T_{ds}{}^mC_{ds}{}^mC_{ds}A_{ds}{}^mC_{ds}T_{ks}G_{ks}{}^mC_k$ | 18 | 2885 |
| 1341978 | 1261 | 1276 | 21076 | 21091 | AGGTAGCTTTTGTCCA | $A_{ks}G_{ks}G_{ks}T_{ds}A_{ys}G_{ds}{}^mC_{ds}T_{ds}T_{ds}T_{ds}T_{ds}G_{ds}T_{ds}{}^mC_{ks}{}^mC_{ks}A_k$ | 59 | 109 |
| 1341979 | 1259 | 1274 | 21074 | 21089 | GTAGCTTTTGTCCACC | $G_{ks}T_{ks}A_{ks}G_{ds}C_{ys}T_{ds}T_{ds}T_{ds}T_{ds}G_{ds}T_{ds}{}^mC_{ds}{}^mC_{ds}A_{ks}{}^mC_{ks}{}^mC_k$ | 64 | 1978 |
| 1341980 | 1258 | 1273 | 21073 | 21088 | TAGCUTTTGTCCACCT | $T_{ks}A_{ks}G_{ks}{}^mC_{ds}U_{ys}T_{ds}T_{ds}T_{ds}G_{ds}T_{ds}{}^mC_{ds}{}^mC_{ds}A_{ds}{}^mC_{ks}{}^mC_{ks}T_k$ | 67 | 2896 |

Example 4: Design of and Antisense Inhibition by Human HSD171B13 Modified Oligonucleotides in HepRG Cells Modified oligonucleotides complementary to an HSD17813 nucleic acid were synthesized and tested for their effect on HSD17B813 RNA levels in vitro, specifies the chemistry of each modified oligonucleotide; wherein subscript 'd' represents a 2'-β-D-deoxyribosyl sugar moiety, subscript 'e' represents a 2'-MOE sugar moiety, subscript 'y' represents a 2'-O-methyl sugar moiety, subscript 'k' represents a cEt modified sugar moiety, subscript 's' represents a phosphorothioate internucleoside linkage, and superscript 'in' before the cytosine residue represents a 5-methyl cytosine. "Start site" indicates the 5'-most nucleoside of the target sequence to which the modified oligonucleotide is complementary. "Stop site" indicates the 3'-most nucleoside of the target sequence to which the modified oligonucleotide is complementary. As shown in the Tables below, the modified oligonucleotide are complementary to either the human HSD17B13 mRNA, designated herein as SEQ ID NO: 1 (GENBANK Accession No. NM_178135.4) or to the human HSD17B13 genomic sequence, designated herein as SEQ ID NO: 2 (the complement of GENBANK Accession No. NC_000004.12 truncated from nucleotides 87301001 to 87326000) or to both. 'N/A' indicates that the modified oligonucleotide is not complementary to that particular target sequence with 100% complementarity.

The modified oligonucleotides were tested in a series of experiments using the same culture conditions. The results for each experiment are presented in separate tables shown below. Cultured HepaRG cells at a density of 30,000 cells per well were transfected using electroporation with 1,000 nM of modified oligonucleotide. After a treatment period of approximately 24 hours, RNA was isolated from the cells and HSD17B13 RNA levels were measured by quantitative real-time RTPCR. Human primer probe set RTS43553 was used to measure RNA levels. HSD17B3 RNA levels were adjusted according to total RNA content, as measured by RIBOGREEN®. Results are presented as percent inhibition of HSD17B13 relative to untreated control cells. As used herein, a value of '0' indicates that treatment with the modified oligonucleotide did not inhibit HSD17B13 mRNA levels.

TABLE 50

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^{m}C_{ks}A_{k}$ | 81 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^{m}C_{ds}A_{ds}T_{ds}T_{ds}{}^{m}C_{ds}A_{ks}G_{ks}T_{k}$ | 83 | 1526 |
| 1340072 | N/A | N/A | 19913 | 19928 | GTGCATCTTAAGATAC | $G_{ks}T_{ks}G_{ks}{}^{m}C_{ds}A_{ds}T_{ds}{}^{m}C_{ds}T_{ds}T_{ds}A_{ds}A_{ds}G_{ds}A_{ds}T_{ks}A_{ks}{}^{m}C_{k}$ | 47 | 2806 |
| 1340095 | N/A | N/A | 19395 | 19410 | ATAAGAGATGAGTAGG | $A_{ks}T_{ks}A_{ks}A_{ds}G_{ds}A_{ds}G_{ds}A_{ds}T_{ds}G_{ds}A_{ds}G_{ds}T_{ds}A_{ks}G_{ks}G_{k}$ | 56 | 2897 |
| 1340097 | N/A | N/A | 14604 | 14619 | TGCGAGAAATCTAAGA | $T_{ks}G_{ks}{}^{m}C_{ks}G_{ds}A_{ds}G_{ds}A_{ds}A_{ds}A_{ds}T_{dsin}C_{ds}T_{ds}A_{ds}A_{ks}G_{ks}A_{k}$ | 50 | 2898 |
| 1340102 | N/A | N/A | 10521 | 10536 | TATAACATGGCTGGCA | $T_{ks}A_{ks}T_{ks}A_{ds}A_{ds}{}^{m}C_{ds}A_{ds}T_{ds}G_{ds}G_{ds}{}^{m}C_{ds}T_{ds}G_{ds}G_{ks}{}^{m}C_{ks}A_{k}$ | 33 | 2899 |
| 1340109 | 1432 | 1447 | 21247 | 21262 | AAAATATGTCCAGGTT | $A_{ks}A_{ks}A_{ks}A_{ds}T_{ds}A_{ds}T_{ds}G_{ds}T_{ds}{}^{m}C_{ds}{}^{m}C_{ds}A_{ds}G_{ds}G_{ks}T_{ks}T_{k}$ | 74 | 2900 |
| 1340134 | N/A | N/A | 9967 | 9982 | GTAGTGTAAGCTGAGA | $G_{ks}T_{ks}A_{ks}G_{ds}T_{ds}G_{ds}T_{ds}A_{ds}A_{ds}G_{ds}{}^{m}C_{ds}T_{ds}G_{ds}A_{ks}G_{ks}A_{k}$ | 81 | 2901 |
| 1340137 | N/A | N/A | 18139 | 18154 | ATGTTATCTCAAGTCA | $A_{ks}T_{ks}G_{ks}T_{ds}T_{ds}A_{ds}T_{ds}{}^{m}C_{ds}T_{ds}{}^{m}C_{ds}A_{ds}A_{ds}G_{ds}T_{ks}{}^{m}C_{ks}A_{k}$ | 79 | 2902 |
| 1340138 | 1632 | 1647 | 21447 | 21462 | GATTTAAAATAGAGTC | $G_{ks}A_{ks}T_{ks}T_{ds}T_{ds}A_{ds}A_{ds}A_{ds}A_{ds}T_{ds}A_{ds}G_{ds}A_{ds}G_{ks}T_{ks}{}^{m}C_{k}$ | 46 | 2903 |
| 1340155 | N/A | N/A | 9442 | 9457 | CTCCCACAAAACTAAC | ${}^{m}C_{ks}T_{ks}{}^{m}C_{ks}{}^{m}C_{ds}{}^{m}C_{ds}A_{ds}{}^{m}C_{ds}A_{ds}A_{ds}A_{ds}A_{ds}{}^{m}C_{ds}T_{ds}A_{ks}A_{ks}{}^{m}C_{k}$ | 13 | 2904 |

TABLE 50-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1340172 | N/A | N/A | 11623 | 11638 | TTCTGTAGGACTCTGC | $T_{ks}T_{ks}{}^{m}C_{ks}T_{ds}G_{ds}T_{ds}A_{ds}G_{ds}G_{ds}A_{ds}{}^{m}C_{ds}T_{ds}{}^{m}C_{ds}T_{ks}G_{ks}{}^{m}C_{k}$ | 72 | 2905 |
| 1340180 | N/A | N/A | 20417 | 20432 | AAAATTATGCCTTGTG | $A_{ks}A_{ks}A_{ks}A_{ds}T_{ds}T_{ds}A_{ds}T_{ds}G_{ds}{}^{m}C_{ds}{}^{m}C_{ds}T_{ds}T_{ds}TG_{ks}T_{ks}G_{k}$ | 50 | 2906 |
| 1340182 | N/A | N/A | 14915 | 14930 | TACATTAGCAAGCTAA | $T_{ks}A_{ks}{}^{m}C_{ks}A_{ds}T_{ds}T_{ds}A_{ds}G_{ds}{}^{m}C_{ds}A_{ds}A_{ds}G_{ds}{}^{m}C_{ds}T_{ks}A_{ks}A_{k}$ | 29 | 2907 |
| 1340213 | N/A | N/A | 20593 | 20608 | GCTGAGAGTTATCTGG | $G_{ks}{}^{m}C_{ks}T_{ks}G_{ds}A_{ds}G_{ds}A_{ds}G_{ds}T_{ds}T_{ds}A_{ds}T_{ds}{}^{m}C_{ds}T_{ks}G_{ks}G_{k}$ | 65 | 2908 |
| 1340249 | N/A | N/A | 18037 | 18052 | TCATAGTTTATATGGA | $T_{ks}{}^{m}C_{ks}A_{ks}T_{ds}A_{ds}G_{ds}T_{ds}T_{ds}T_{ds}A_{ds}T_{ds}A_{ds}T_{ds}G_{ks}G_{ks}A_{k}$ | 44 | 2909 |
| 1340263 | N/A | N/A | 13609 | 13624 | TTGAAGACAATACAGG | $T_{ks}T_{ks}G_{ks}A_{ds}A_{ds}G_{ds}A_{ds}{}^{m}C_{ds}A_{ds}A_{ds}T_{ds}A_{ds}{}^{m}C_{ds}A_{ks}G_{ks}G_{k}$ | 63 | 2910 |
| 1340282 | N/A | N/A | 19535 | 19550 | ATAGGCTAAAATGGTC | $A_{ks}T_{ks}A_{ks}G_{ds}G_{ds}{}^{m}C_{ds}T_{ds}A_{ds}A_{ds}A_{ds}A_{ds}T_{ds}G_{ds}G_{ks}T_{ks}{}^{m}C_{k}$ | 61 | 2911 |
| 1340287 | N/A | N/A | 18696 | 18711 | AAAAGACTTTGAGACT | $A_{ks}A_{ks}A_{ks}A_{ds}G_{ds}A_{ds}{}^{m}C_{ds}T_{ds}T_{ds}T_{ds}G_{ds}A_{ds}G_{ds}A_{ks}{}^{m}C_{ks}T_{k}$ | 32 | 2912 |
| 1340288 | N/A | N/A | 11115 | 11130 | ACAGAGGAGTTTGCAG | $A_{ks}{}^{m}C_{ks}A_{ds}G_{ds}A_{ds}G_{ds}G_{ds}A_{ds}G_{ds}T_{ds}T_{ds}T_{ds}G_{ds}{}^{m}C_{ks}A_{ks}G_{k}$ | 37 | 2913 |
| 1340289 | 1309 | 1324 | 21124 | 21139 | TTAAACCTTCCCTGTG | $T_{ks}T_{ks}A_{ks}A_{ds}A_{ds}{}^{m}C_{ds}{}^{m}C_{ds}T_{ds}T_{ds}{}^{m}C_{ds}{}^{m}C_{ds}{}^{m}C_{ds}T_{ds}G_{ks}T_{ks}G_{k}$ | 22 | 2807 |
| 1340295 | 1178 | 1193 | 20993 | 21008 | TTTTAAGAGGCATGAA | $T_{ks}T_{ks}T_{ks}T_{ds}A_{ds}A_{ds}G_{ds}A_{ds}G_{ds}G_{ds}{}^{m}C_{ds}A_{ds}T_{ds}G_{ks}A_{ks}A_{k}$ | 53 | 2914 |
| 1340301 | N/A | N/A | 20113 | 20128 | CATCAAGACATTCTAG | ${}^{m}C_{ks}A_{ks}T_{ks}{}^{m}C_{ds}A_{ds}A_{ds}G_{ds}A_{ds}{}^{m}C_{ds}A_{ds}T_{ds}T_{ds}{}^{m}C_{ds}T_{ks}A_{ks}G_{k}$ | 49 | 2915 |
| 1340306 | N/A | N/A | 19732 | 19747 | AACTGAAGGTCTGAGC | $A_{ks}A_{ks}{}^{m}C_{ks}T_{ds}G_{ds}A_{ds}A_{ds}G_{ds}G_{ds}T_{ds}{}^{m}C_{ds}T_{ds}G_{ds}A_{ks}G_{ks}{}^{m}C_{k}$ | 55 | 2916 |
| 1340315 | N/A | N/A | 14284 | 14299 | TGAATGTAAAGGCTGG | $T_{ks}G_{ks}A_{ks}A_{ds}T_{ds}G_{ds}T_{ds}A_{ds}A_{ds}A_{ds}G_{ds}G_{ds}{}^{m}C_{ds}T_{ks}G_{ks}G_{k}$ | 38 | 2917 |
| 1340333 | 1764 | 1779 | 21579 | 21594 | TACAGTTCCTTTTCCT | $T_{ks}A_{ks}{}^{m}C_{ks}A_{ds}G_{ds}T_{ds}T_{ds}{}^{m}C_{ds}{}^{m}C_{ds}T_{ds}T_{ds}T_{ds}T_{ds}{}^{m}C_{ks}{}^{m}C_{ks}T_{k}$ | 68 | 2918 |
| 1340340 | N/A | N/A | 6913 | 6928 | TCGGGAAGTTTAGACA | $T_{ks}{}^{m}C_{ks}G_{ks}G_{ds}G_{ds}A_{ds}A_{ds}G_{ds}T_{ds}T_{ds}T_{ds}A_{ds}G_{ds}A_{ks}{}^{m}C_{ks}A_{k}$ | 43 | 2919 |
| 1340341 | N/A | N/A | 6330 | 6345 | GACTTTCATAGGGAGA | $G_{ks}A_{ks}{}^{m}C_{ks}T_{ds}T_{ds}T_{ds}{}^{m}C_{ds}A_{ds}T_{ds}A_{ds}G_{ds}G_{ds}G_{ds}A_{ks}G_{ks}A_{k}$ | 72 | 2920 |
| 1340346 | N/A | N/A | 11510 | 11525 | ATTATGAGGATCTGGA | $A_{ks}T_{ksrrks}A_{ds}T_{ds}G_{ds}A_{ds}G_{ds}G_{ds}A_{ds}T_{ds}{}^{m}C_{ds}T_{ds}G_{ks}G_{ks}A_{k}$ | 49 | 2921 |

TABLE 50-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1340359 | N/A | N/A | 13949 | 13964 | AAGTTAGCCCCCAGGA | $A_{ks}A_{ks}G_{ks}T_{ds}T_{ds}A_{ds}G_{ds}{}^mC_{ds}{}^mC_{ds}{}^mC_{ds}{}^mC_{ds}{}^mC_{ds}A_{ds}G_{ks}A_k$ | 36 | 2811 |
| 1340362 | N/A | N/A | 6734 | 6749 | GATTACCCCTGGCTTT | $G_{ks}A_{ks}T_{ks}T_{ds}A_{ds}{}^mC_{ds}{}^mC_{ds}{}^mC_{ds}{}^mC_{ds}T_{ds}G_{ds}G_{ds}{}^mC_{ds}T_{ks}T_{ks}T_k$ | 31 | 2922 |
| 1340391 | N/A | N/A | 12204 | 12219 | TATCATACCACATACC | $T_{ks}A_{ks}T_{ks}{}^mC_{ds}A_{ds}T_{ds}A_{ds}{}^mC_{ds}{}^mC_{ds}A_{ds}{}^mC_{ds}A_{ds}T_{ds}A_{ks}{}^mC_{ks}{}^mC_k$ | 24 | 2923 |
| 1340393 | N/A | N/A | 5744 | 5759 | CACTGATTTAGTTGGT | $^mC_{ks}A_{ks}{}^mC_{ks}T_{ds}G_{ds}A_{ds}T_{ds}T_{ds}T_{ds}A_{ds}G_{ds}T_{ds}T_{ds}G_{ks}G_{ks}T_k$ | 66 | 2924 |
| 1340399 | N/A | N/A | 15419 | 15434 | CCAGTAGGTGTGTTTC | $^mC_{ks}{}^m{}_nC_{ks}A_{ks}G_{ds}T_{ds}A_{ds}G_{ds}G_{ds}T_{ds}G_{ds}T_{ds}G_{ds}T_{ds}T_{ks}T_{ks}{}^mC_k$ | 55 | 2925 |
| 1340403 | N/A | N/A | 5673 | 5688 | GGTCAGTAGAGAGCAT | $G_{ks}G_{ks}T_{ks}{}^mC_{ds}A_{ds}G_{ds}T_{ds}A_{ds}G_{ds}A_{ds}G_{ds}A_{ds}G_{ds}{}^mC_{ks}A_{ks}T_k$ | 79 | 2926 |
| 1340409 | 683 | 698 | 12101 | 12116 | GATACCAGTTTTTCCC | $G_{ks}A_{ks}T_{ks}A_{ds}{}^mC_{ds}{}^mC_{ds}A_{ds}G_{ds}T_{ds}T_{ds}T_{ds}T_{ds}T_{ds}{}^mC_{ks}{}^mC_{ks}{}^mC_k$ | 75 | 2927 |
| 1340411 | N/A | N/A | 9206 | 9221 | AGATGTACACTGACAA | $A_{ks}G_{ks}A_{ks}T_{ds}G_{ds}T_{ds}A_{ds}{}^mC_{ds}A_{ds}{}^mC_{ds}T_{ds}G_{ds}A_{ds}{}^mC_{ks}A_{ks}A_k$ | 66 | 2928 |
| 1340420 | N/A | N/A | 20193 | 20208 | TGCAGTTATTAGAAGT | $T_{ks}G_{ks}{}^mC_{ks}A_{ds}G_{ds}T_{ds}T_{ds}A_{ds}T_{ds}T_{ds}A_{ds}G_{ds}A_{ds}A_{c_{is}}A_{ks}G_{ks}T_k$ | 46 | 2929 |
| 1340444 | N/A | N/A | 8963 | 8978 | CTCCGTTATAAGTTTC | $^mC_{ks}T_{ks}{}^mC_{ks}{}^mC_{ds}G_{ds}T_{ds}T_{ds}A_{ds}T_{ds}A_{ds}A_{ds}G_{ds}T_{ds}T_{ks}T_{ks}{}^mC_k$ | 59 | 2930 |
| 1340456 | N/A | N/A | 16218 | 16233 | TATAGACTGGGTAGGA | $T_{ks}A_{ks}T_{ks}A_{ds}G_{ds}A_{ds}{}^mC_{ds}T_{ds}G_{ds}G_{ds}G_{ds}T_{ds}A_{ds}G_{ks}G_{ks}A_k$ | 61 | 2808 |
| 1340460 | N/A | N/A | 9775 | 9790 | ACTAGAACTCCCAACC | $A_{ks}{}^mC_{ks}T_{ks}A_{ds}G_{ds}A_{ds}A_{ds}{}^mC_{ds}T_{ds}{}^mC_{ds}{}^mC_{ds}{}^mC_{ds}A_{ds}A_{ks}{}^mC_{ks}{}^mC_k$ | 20 | 2931 |
| 1340467 | N/A | N/A | 8129 | 8144 | TTAGAGTGCTTAGTTC | $T_{ks}T_{ks}A_{ks}G_{ds}A_{ds}G_{ds}T_{ds}G_{ds}{}^mC_{ds}T_{ds}T_{ds}A_{ds}G_{ds}T_{ks}T_{ks}{}^mC_k$ | 58 | 2932 |
| 1340473 | N/A | N/A | 3608 | 3623 | TTTAGCAGCTTGGAAG | $T_{ks}T_{ks}T_{ks}A_{ds}G_{ds}{}^mC_{ds}A_{ds}G_{ds}{}^mC_{ds}T_{ds}T_{ds}G_{ds}G_{ds}A_{ks}A_{ks}G_k$ | 43 | 2933 |
| 1340474 | N/A | N/A | 16425 | 16440 | TGATATGTCAATACTC | $T_{ks}G_{ks}A_{ks}T_{ds}A_{ds}T_{ds}G_{ds}T_{ds}{}^mC_{ds}A_{ds}A_{ds}T_{ds}A_{ds}{}^mC_{ks}T_{ds}{}^mC_k$ | 57 | 2934 |
| 1340490 | N/A | N/A | 10124 | 10139 | GGATATGTCATCTAAA | $G_{ks}G_{ks}A_{ks}T_{ds}A_{ds}T_{ds}G_{ds}T_{ds}{}^mC_{ds}A_{ds}T_{ds}{}^mC_{ds}T_{ds}A_{ks}A_{ks}A_k$ | 68 | 2935 |
| 1340494 | N/A | N/A | 5896 | 5911 | GTCCTTTGTATTTCGC | $G_{ks}T_{ks}{}^mC_{ks}{}^mC_{ds}T_{ds}T_{ds}T_{ds}G_{ds}T_{ds}A_{ds}T_{ds}T_{ds}T_{ds}{}^mC_{ks}G_{ks}{}^mC_k$ | 45 | 2936 |
| 1340520 | N/A | N/A | 3701 | 3716 | ATTTTCAGATCCCGTT | $A_{ks}T_{ks}T_{ks}T_{ds}T_{ds}{}^mC_{ds}A_{ds}G_{ds}A_{ds}T_{ds}{}^mC_{ds}{}^mC_{ds}{}^mC_{ds}G_{ks}T_{ks}T_k$ | 67 | 2937 |

TABLE 50-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1340530 | N/A | N/A | 3490 | 3505 | TACAGACTAAGGGACC | $T_{ks}A_{ks}{}^mC_{ks}A_{ds}G_{ds}A_{ds}{}^mC_{ds}T_{ds}A_{ds}A_{ds}G_{ds}G_{ds}A_{ks}{}^mC_{ks}{}^mC_k$ | 68 | 2938 |
| 1340531 | N/A | N/A | 9337 | 9352 | CCTCGATCCTATATAC | ${}^mC_{ks}{}^mC_{ks}T_{ks}{}^mC_{ds}G_{ds}A_{ds}T_{ds}{}^mC_{ds}{}^mC_{ds}T_{ds}A_{ds}T_{ds}A_{ds}T_{ks}A_{ks}{}^mC_k$ | 31 | 2812 |
| 1340532 | N/A | N/A | 12801 | 12816 | AGGCTGTAAGAGTCAG | $A_{ks}G_{ks}G_{ks}{}^mC_{ds}T_{ds}G_{ds}T_{ds}A_{ds}A_{ds}G_{ds}A_{ds}G_{ds}T_{ds}{}^mC_{ks}A_{ks}G_k$ | 74 | 2809 |
| 1340565 | N/A | N/A | 5844 | 5859 | CCCCAAACATGGATGT | ${}^mC_{ks}{}^mC_{ks}{}^mC_{ks}{}^mC_{ds}A_{ds}A_{ds}A_{ds}{}^mC_{ds}A_{ds}T_{ds}G_{ds}G_{ds}A_{ds}T_{ks}G_{ks}T_k$ | 62 | 2939 |
| 1340586 | 811 | 826 | 15692 | 15707 | TTATTGGTAAGTATTC | $T_{ks}T_{ks}A_{ks}T_{ds}T_{ds}G_{ds}G_{ds}T_{ds}A_{ds}A_{ds}G_{ds}T_{ds}A_{ds}T_{ks}T_{ks}{}^mC_k$ | 17 | 2940 |
| 1340599 | N/A | N/A | 6599 | 6614 | GGCTACTTTCAAACCT | $G_{ks}G_{ks}{}^mC_{ks}T_{ds}A_{ds}{}^mC_{ds}T_{ds}T_{ds}T_{ds}{}^mC_{ds}A_{ds}A_{ds}A_{ds}{}^mC_{ks}{}^mC_{ks}T_k$ | 54 | 2941 |
| 1340600 | N/A | N/A | 8538 | 8553 | GTTTTGCAAGTTTATC | $G_{ks}T_{ks}T_{ks}T_{ds}T_{ds}G_{ds}{}^mC_{ds}A_{ds}A_{ds}G_{ds}T_{ds}T_{ds}T_{ds}A_{ks}T_{ks}{}^mC_k$ | 73 | 2942 |
| 1340612 | N/A | N/A | 6450 | 6465 | AGTAGTAATTCTAAAC | $A_{ks}G_{ks}T_{ks}A_{ds}G_{ds}T_{ds}A_{ds}A_{ds}T_{ds}T_{ds}{}^mC_{ds}T_{ds}A_{ds}A_{ks}A_{ks}{}^mC_k$ | 23 | 2943 |
| 1340625 | N/A | N/A | 7527 | 7542 | TCCGAAAAAAGTGGAG | $T_{ks}{}^mC_{ks}{}^mC_{ks}G_{ds}A_{ds}A_{ds}A_{ds}A_{ds}A_{ds}A_{ds}G_{ds}T_{ds}G_{ds}G_{ks}A_{ks}G_k$ | 12 | 2944 |
| 1340627 | N/A | N/A | 10292 | 10307 | GAGAGAACTTATACAA | $G_{ks}A_{ks}G_{ks}A_{ds}G_{ds}A_{ds}A_{ds}{}^mC_{ds}T_{ds}T_{ds}A_{ds}T_{ds}A_{ds}{}^mC_{ks}A_{ks}A_k$ | 37 | 2945 |
| 1340629 | 77 | 92 | 3171 | 3186 | CAGAAGGATTTCTAGG | ${}^mC_{ks}A_{ks}G_{ks}A_{ds}A_{ds}G_{ds}G_{ds}A_{ds}T_{ds}T_{ds}T_{ds}{}^mC_{ds}T_{ds}A_{ks}G_{ks}G_k$ | 43 | 2946 |
| 1340633 | N/A | N/A | 4662 | 4677 | CCCGCCCTTAAGTCAT | ${}^mC_{ks}{}^mC_{ks}{}^mC_{ks}G_{ds}{}^mC_{ds}{}^mC_{ds}{}^mC_{ds}T_{ds}T_{ds}A_{ds}A_{ds}G_{ds}T_{ds}{}^mC_{ks}A_{ks}T_k$ | 45 | 2947 |
| 1340643 | N/A | N/A | 5277 | 5292 | GCTAGACAATTGCAAA | $G_{ks}{}^mC_{ks}T_{ks}A_{ds}G_{ds}A_{ds}{}^mC_{ds}A_{ds}A_{ds}T_{ds}T_{ds}G_{ds}{}^mC_{ds}A_{ks}A_{ks}A_k$ | 77 | 2948 |
| 1340686 | N/A | N/A | 5189 | 5204 | TTCCCAACGCAACAGT | $T_{ks}T_{ks}{}^mC_{ks}{}^mC_{ds}{}^mC_{ds}A_{ds}A_{ds}{}^mC_{ds}G_{ds}{}^mC_{ds}A_{ds}A_{ds}{}^mC_{ds}A_{ks}G_{ks}T_k$ | 60 | 2949 |
| 1340694 | N/A | N/A | 5648 | 5663 | GAGCATTCATCAGATG | $G_{ks}A_{ks}G_{ks}{}^mC_{ds}A_{ds}T_{ds}T_{ds}{}^mC_{ds}A_{ds}T_{ds}{}^mC_{ds}A_{ds}G_{ds}A_{ks}T_{ks}G_k$ | 64 | 2950 |
| 1340698 | N/A | N/A | 6087 | 6102 | AGTTTTCACCTCAGGT | $A_{ks}G_{ks}T_{ks}T_{ds}T_{ds}T_{ds}{}^mC_{ds}A_{ds}{}^mC_{ds}{}^mC_{ds}T_{ds}{}^mC_{ds}A_{ds}G_{ks}G_{ks}T_k$ | 82 | 2951 |
| 1340709 | N/A | N/A | 9116 | 9131 | AGACAGACCAAGTAGC | $A_{ks}G_{ks}A_{ks}{}^mC_{ds}A_{ds}G_{ds}A_{ds}{}^mC_{ds}{}^mC_{ds}A_{ds}A_{ds}G_{ds}T_{ds}A_{ks}G_{ks}{}^mC_k$ | 21 | 2952 |
| 1340719 | N/A | N/A | 9944 | 9959 | ACCACACTAATGAATC | $A_{ks}{}^mC_{ks}{}^mC_{ks}A_{ds}{}^mC_{ds}A_{ds}{}^mC_{ds}T_{ds}A_{ds}A_{ds}T_{ds}G_{ds}A_{ds}A_{ks}T_{ks}{}^mC_k$ | 54 | 2953 |

TABLE 50-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1340726 | N/A | N/A | 6262 | 6277 | TGAGATGGGCAAGGCC | $T_{ks}G_{ks}A_{ks}G_{ds}A_{ds}T_{ds}G_{ds}G_{ds}G_{ds}{}^mC_{ds}A_{ds}A_{ds}G_{ds}G_{ks}{}^mC_{ks}{}^mC_k$ | 53 | 2954 |
| 1340728 | N/A | N/A | 8645 | 8660 | GGCAAGACAGACTGTT | $G_{ks}G_{ks}{}^mC_{ks}A_{ds}A_{ds}G_{ds}A_{ds}{}^mC_{ds}A_{ds}G_{ds}A_{ds}{}^mC_{ds}T_{ds}G_{ks}T_{ks}T_k$ | 75 | 2955 |
| 1340729 | N/A | N/A | 14191 | 14206 | GATTGAGTTCTCCACT | $G_{ks}A_{ks}T_{ks}T_{ds}G_{ds}A_{ds}G_{ds}T_{ds}T_{ds}{}^mC_{ds}T_{ds}{}^mC_{ds}{}^mC_{ds}A_{ks}{}^mC_{ks}T_k$ | 45 | 2956 |
| 1340739 | N/A | N/A | 16288 | 16303 | TTAGAATAGTCTTCAG | $T_{ks}T_{ks}A_{ks}G_{ds}A_{ds}A_{ds}T_{ds}A_{ds}G_{ds}T_{ds}{}^mC_{ds}T_{ds}T_{ds}{}^mC_{ks}A_{ks}G_k$ | 52 | 2957 |
| 1340752 | N/A | N/A | 9590 | 9605 | AGCTGGTAAAGGTAAG | $A_{ks}G_{ks}{}^mC_{ks}T_{ds}G_{ds}G_{ds}T_{ds}A_{ds}A_{ds}A_{ds}G_{ds}G_{ds}T_{ds}A_{ks}A_{ks}G_k$ | 55 | 2958 |
| 1340755 | N/A | N/A | 3995 | 4010 | ATGTAGTGTTTACAAG | $A_{ks}T_{ks}G_{ks}T_{ds}A_{ds}G_{ds}T_{ds}G_{ds}T_{ds}T_{ds}T_{ds}A_{ds}{}^mC_{ds}A_{ks}A_{ks}G_k$ | 58 | 2959 |
| 1340769 | N/A | N/A | 12666 | 12681 | GTTAACCTGCAGCAGA | $G_{ks}T_{ks}T_{ks}A_{ds}A_{ds}{}^mC_{ds}{}^mC_{ds}T_{ds}G_{ds}{}^mC_{ds}A_{ds}G_{ds}{}^mC_{ds}A_{ks}G_{ks}A_k$ | 51 | 2960 |
| 1340791 | N/A | N/A | 17953 | 17968 | TAGAAACTGCTCCTCA | $T_{ks}A_{ks}G_{ks}A_{ds}A_{ds}A_{ds}{}^mC_{ds}T_{ds}G_{ds}{}^mC_{ds}T_{ds}{}^mC_{ds}{}^mC_{ds}T_{ks}{}^mC_{ks}A_k$ | 32 | 2961 |
| 1340795 | N/A | N/A | 7789 | 7804 | GTGACATAACTACTTC | $G_{ks}T_{ks}G_{ks}A_{ds}{}^mC_{ds}A_{ds}T_{ds}A_{ds}A_{ds}{}^mC_{ds}T_{ds}A_{ds}{}^mC_{ds}T_{ks}T_{ks}{}^mC_k$ | 68 | 2962 |
| 1340801 | N/A | N/A | 4246 | 4261 | TAAGTGTAAGAGACAT | $T_{ks}A_{ks}A_{ks}G_{ds}T_{ds}G_{ds}T_{ds}A_{ds}A_{ds}G_{ds}A_{ds}G_{ds}A_{ds}{}^mC_{ks}A_{ks}T_k$ | 63 | 2963 |
| 1340810 | N/A | N/A | 12480 | 12495 | GGAGCTAGATACTCAA | $G_{ks}G_{ks}A_{ks}G_{ds}{}^mC_{ds}T_{ds}A_{ds}G_{ds}A_{ds}T_{ds}A_{ds}{}^mC_{ds}T_{ds}{}^mC_{ks}A_{ks}A_k$ | 42 | 2964 |
| 1340819 | N/A | N/A | 18530 | 18545 | TCCTACAGTGCTTAGT | $T_{ks}{}^mC_{ks}{}^mC_{ks}T_{ds}A_{ds}{}^mC_{ds}A_{ds}G_{ds}T_{ds}G_{ds}{}^mC_{ds}T_{ds}T_{ds}A_{ks}G_{ks}T_k$ | 44 | 2965 |
| 1340907 | N/A | N/A | 5121 | 5136 | AAGGAGCCAGTTATGA | $A_{ks}A_{ks}G_{rks}G_{ds}A_{ds}G_{ds}{}^mC_{ds}{}^mC_{ds}A_{ds}G_{ds}T_{ds}T_{ds}A_{ds}T_{ks}G_{ks}A_k$ | 57 | 2966 |
| 1340917 | N/A | N/A | 9666 | 9681 | ATGCAGCTATAGGTAG | $A_{ks}T_{ks}G_{ks}{}^mC_{ds}A_{ds}G_{ds}{}^mC_{ds}T_{ds}A_{ds}T_{ds}A_{ds}G_{ds}G_{ds}T_{ks}A_{ks}G_k$ | 41 | 2967 |

TABLE 51

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}G_{ds}T_{ds}A_{ds}A_{ds}G_{ds}T_{ks}{}^mC_{ks}A_k$ | 77 | 121 |

TABLE 51-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}{}^mC_{ds}A_{ds}T_{ds}T_{ds}{}^mC_{ds}A_{ks}G_{ks}T_k$ | 81 | 1526 |
| 1341164 | 610 | 625 | N/A | N/A | GAACAATATGGGATGA | $G_{ks}A_{ks}A_{ds}{}^mC_{ds}A_{ds}A_{ds}T_{ds}A_{ds}T_{ds}G_{ds}G_{ds}G_{ks}A_{es}T_{ks}G_{es}A_k$ | 49 | 1735 |
| 1341172 | 812 | 827 | 15693 | 15708 | CTTATTGGTAAGTATT | ${}^mC_{ks}T_{ks}T_{ds}A_{ds}T_{ds}T_{ds}G_{ds}G_{ds}T_{ds}A_{ds}A_{ds}G_{ks}T_{es}A_{ks}T_{es}T_k$ | 9 | 1350 |
| 1341178 | 698 | 713 | 12116 | 12131 | GAGACATGAGGTTTTG | $G_{ks}A_{ks}G_{ds}A_{ds}{}^mC_{ds}A_{ds}T_{ds}G_{ds}A_{ds}G_{ds}G_{ds}T_{ks}T_{es}T_{ks}T_{es}G_k$ | 49 | 725 |
| 1341186 | 1079 | 1094 | 20894 | 20909 | GCTAGTGCCAAACCAA | $G_{ks}{}^mC_{ks}T_{ds}A_{ds}G_{ds}T_{ds}G_{ds}{}^mC_{ds}{}^mC_{ds}A_{ds}A_{ds}A_{ks}{}^mC_{es}{}^mC_{ks}A_{es}A_k$ | 62 | 1354 |
| 1341188 | 1017 | 1032 | 20832 | 20847 | CAGCATTGATTCGAAA | ${}^mC_{ks}A_{ks}G_{ds}{}^mC_{ds}A_{ds}T_{ds}T_{ds}G_{ds}A_{ds}T_{ds}T_{ds}{}^mC_{ks}G_{es}A_{ks}A_{es}A_k$ | 58 | 263 |
| 1341192 | 1200 | 1215 | 21015 | 21030 | ATGTTTATGTAAGCAC | $A_{ks}T_{ks}G_{ds}T_{ds}T_{ds}T_{ds}A_{ds}T_{ds}G_{ds}T_{ds}A_{ds}A_{ks}G_{es}{}^mC_{ks}A_{es}{}^mC_k$ | 61 | 2622 |
| 1341196 | 1088 | 1103 | 20903 | 20918 | TTGACTGCTGCTAGTG | $T_{ks}T_{ks}G_{ds}A_{ds}{}^mC_{ds}T_{ds}G_{ds}{}^mC_{ds}T_{ds}G_{ds}{}^mC_{ds}T_{ks}A_{es}G_{ks}T_{es}G_k$ | 29 | 28 |
| 1341199 | 1083 | 1098 | 20898 | 20913 | TGCTGCTAGTGCCAAA | $T_{ks}G_{ks}{}^mC_{ds}T_{ds}G_{ds}{}^mC_{ds}T_{ds}A_{ds}G_{ds}T_{ds}G_{ds}{}^mC_{ds}{}^mC_{es}A_{ks}A_{es}A_k$ | 40 | 1665 |
| 1341203 | 1311 | 1326 | 21126 | 21141 | TCTTAAACCTTCCCTG | $T_{ks}{}^mC_{ks}T_{ds}T_{ds}A_{ds}A_{ds}A_{ds}{}^mC_{ds}{}^mC_{ds}T_{ds}T_{ds}{}^mC_{ks}{}^mC_{es}{}^mC_{ks}T_{es}G_k$ | 24 | 2160 |
| 1341208 | 1315 | 1330 | 21130 | 21145 | ACAGTCTTAAACCTTC | $A_{ks}{}^mC_{ks}A_{ds}G_{ds}T_{ds}{}^mC_{ds}T_{ds}T_{ds}A_{ds}A_{ds}A_{ds}{}^mC_{ks}{}^mC_{es}T_{ks}T_{es}{}^mC_k$ | 46 | 110 |
| 1341209 | 1257 | 1272 | 21072 | 21087 | AGCTTTTGTCCACCTT | $A_{ks}G_{ks}{}^mC_{ds}T_{ds}T_{ds}T_{ds}T_{ds}G_{ds}T_{ds}{}^mC_{ds}{}^mC_{ds}A_{ks}{}^mC_{es}{}^mC_{ks}T_{es}T_k$ | 62 | 1822 |
| 1341215 | 1323 | 1338 | 21138 | 21153 | CTACTTGAACAGTCTT | ${}^mC_{ks}T_{ks}A_{ds}{}^mC_{ds}T_{ds}T_{ds}G_{ds}A_{ds}A_{ds}{}^mC_{ds}A_{ds}G_{ks}T_{es}{}^mC_{ks}T_{es}T_k$ | 47 | 734 |
| 1341221 | 1327 | 1342 | 21142 | 21157 | AATGCTACTTGAACAG | $A_{ks}A_{ks}T_{ds}G_{ds}{}^mC_{ds}T_{ds}A_{ds}{}^mC_{ds}T_{ds}T_{ds}G_{ds}A_{ks}A_{es}{}^mC_{ks}A_{es}G_k$ | 39 | 1045 |
| 1341224 | 1337 | 1352 | 21152 | 21167 | TACAGATTGGAATGCT | $T_{ks}A_{ks}{}^mC_{ds}A_{ds}G_{ds}A_{ds}T_{ds}T_{ds}G_{ds}G_{ds}A_{ds}A_{ks}T_{es}G_{ks}{}^mC_{es}T_k$ | 35 | 1746 |
| 1341229 | 1331 | 1346 | 21146 | 21161 | TTGGAATGCTACTTGA | $T_{ks}T_{ks}G_{ds}G_{ds}A_{ds}A_{ds}T_{ds}G_{ds}{}^mC_{ds}T_{ds}A_{ds}{}^mC_{ks}T_{es}T_{ks}G_{es}A_k$ | 54 | 1279 |
| 1341230 | 1351 | 1366 | 21166 | 21181 | TTCTGTGGCATGGCTA | $T_{ks}T_{ks}{}^mC_{ds}T_{ds}G_{ds}T_{ds}G_{ds}G_{ds}{}^mC_{ds}A_{ds}T_{ds}G_{ks}G_{es}{}^mC_{ks}T_{es}A_k$ | 50 | 812 |
| 1341235 | 1355 | 1370 | 21170 | 21185 | GATATTCTGTGGCATG | $G_{ks}A_{ks}T_{ds}A_{ds}T_{ds}T_{ds}{}^mC_{ds}T_{ds}G_{ds}T_{ds}G_{ds}G_{ks}{}^mC_{es}A_{ks}T_{es}G_k$ | 52 | 1046 |

TABLE 51-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341245 | 1391 | 1406 | 21206 | 21221 | GATCTCTTAGCTGTGC | $G_{ks}A_{ds}T_{ds}{}^mC_{ds}T_{ds}{}^mC_{ds}T_{ds}T_{ds}A_{ds}G_{ds}{}^mC_{ds}T_{ks}G_{es}T_{ks}G_{es}{}^mC_k$ | 45 | 502 |
| 1341249 | 1359 | 1374 | 21174 | 21189 | TGTTGATATTCTGTGG | $T_{ks}G_{ks}T_{ds}T_{ds}G_{ds}A_{ds}T_{ds}A_{ds}T_{ds}T_{ds}{}^mC_{ds}T_{ks}G_{es}T_{ks}G_{es}G_k$ | 54 | 1358 |
| 1341252 | 1431 | 1446 | 21246 | 21261 | AAATATGTCCAGGTTG | $A_{ks}A_{ds}A_{ds}T_{ds}A_{ds}T_{ds}G_{ds}T_{ds}{}^mC_{ds}{}^mC_{ds}A_{ds}G_{ks}G_{es}T_{ks}T_{es}G_k$ | 61 | 581 |
| 1341253 | 1419 | 1434 | 21234 | 21249 | GTTGAGATAAAGCTGC | $G_{ks}T_{ks}T_{ds}G_{ds}A_{ds}G_{ds}A_{ds}T_{ds}A_{ds}A_{ds}A_{ds}G_{ks}{}^mC_{es}T_{ks}G_{es}{}^mC_k$ | 40 | 1748 |
| 1341256 | 1423 | 1438 | 21238 | 21253 | CCAGGTTGAGATAAAG | ${}^mC_{ks}{}^mC_{ks}A_{ds}G_{ds}G_{ds}T_{ds}T_{ds}G_{ds}A_{ds}G_{ds}A_{ds}T_{ks}A_{es}A_{ks}A_{es}G_k$ | 55 | 33 |
| 1341264 | 1492 | 1507 | 21307 | 21322 | CACCGTTTTGGGCTAA | ${}^mC_{ks}A_{ks}{}^mC_{ds}{}^mC_{ds}G_{ds}T_{ds}T_{ds}T_{ds}T_{ds}G_{ds}G_{ds}G_{ks}{}^mC_{es}T_{ks}A_{es}A_k$ | 42 | 1516 |
| 1341270 | 1602 | 1617 | 21417 | 21432 | ATGTATCTTATAAGAC | $A_{ks}T_{ks}G_{ds}T_{ds}A_{ds}T_{ds}{}^mC_{ds}T_{ds}T_{ds}A_{ds}T_{ds}A_{ks}A_{es}G_{ks}A_{es}{}^mC_k$ | 18 | 1751 |
| 1341272 | 1501 | 1516 | 21316 | 21331 | ATAGAGTTGCACCGTT | $A_{ks}T_{ks}A_{ds}G_{ds}A_{ds}G_{ds}T_{ds}T_{ds}G_{ds}{}^mC_{ds}A_{ds}{}^mC_{ks}{}^mC_{es}G_{ks}T_{es}T_k$ | 45 | 192 |
| 1341276 | 1617 | 1632 | 21432 | 21447 | CGGTCACCTTTCATAA | ${}^mC_{ks}G_{ks}G_{ds}T_{ds}{}^mC_{ds}A_{ds}{}^mC_{ds}{}^mC_{ds}T_{ds}T_{ds}T_{ds}{}^mC_{ks}A_{es}T_{ks}A_{es}A_k$ | 70 | 36 |
| 1341278 | 1621 | 1636 | 21436 | 21451 | GAGTCGGTCACCTTTC | $G_{ks}A_{ks}G_{ds}T_{ds}{}^mC_{ds}G_{ds}G_{ds}T_{ds}{}^mC_{ds}A_{ds}{}^mC_{ds}{}^mC_{ks}T_{es}T_{ks}T_{es}{}^mC_k$ | 62 | 350 |
| 1341282 | 1625 | 1640 | 21440 | 21455 | AATAGAGTCGGTCACC | $A_{ks}A_{ds}T_{ds}A_{ds}G_{ds}A_{ds}G_{ds}T_{ds}{}^mC_{ds}G_{ds}G_{ds}T_{ks}{}^mC_{es}A_{ks}{}^mC_{es}{}^mC_k$ | 13 | 662 |
| 1341289 | 1629 | 1644 | 21444 | 21459 | TTAAAATAGAGTCGGT | $T_{ks}T_{ks}A_{ds}A_{ds}A_{ds}A_{ds}T_{ds}A_{ds}G_{ds}A_{ds}G_{ds}T_{ks}{}^mC_{es}G_{ks}G_{es}T_k$ | 51 | 973 |
| 1341293 | 1713 | 1728 | 21528 | 21543 | AACATCTCTGGGACCA | $A_{ks}A_{ks}{}^mC_{ds}A_{ds}T_{ds}{}^mC_{ds}T_{ds}{}^mC_{ds}T_{ds}G_{ds}G_{ds}G_{ks}A_{es}{}^mC_{ks}{}^mC_{es}A_k$ | 36 | 273 |
| 1341294 | 1708 | 1723 | 21523 | 21538 | CTCTGGGACCAAGGAT | ${}^mC_{ks}T_{ks}{}^mC_{ds}T_{ds}G_{ds}G_{ds}G_{ds}A_{ds}{}^mC_{ds}{}^mC_{ds}A_{ds}A_{ks}G_{es}G_{ks}A_{es}T_k$ | 39 | 1908 |
| 1341301 | 1777 | 1792 | 21592 | 21607 | ATGTAATAGCCAGTAC | $A_{ks}T_{ks}G_{ds}T_{ds}A_{ds}A_{ds}T_{ds}A_{ds}G_{ds}{}^mC_{ds}{}^mC_{ds}A_{ks}G_{es}T_{ks}A_{es}{}^mC_k$ | 47 | 430 |
| 1341304 | 1766 | 1781 | 21581 | 21596 | AGTACAGTTCCTTTTC | $A_{ks}G_{ds}T_{ds}A_{ds}{}^mC_{ds}A_{ds}G_{ds}T_{ds}T_{ds}{}^mC_{ds}{}^mC_{ds}T_{ks}T_{es}T_{ks}T_{es}{}^mC_k$ | 40 | 1597 |
| 1341311 | 1773 | 1788 | 21588 | 21603 | AATAGCCAGTACAGTT | $A_{ks}A_{ks}T_{ds}A_{ds}G_{ds}{}^mC_{ds}{}^mC_{ds}A_{ds}G_{ds}T_{ds}A_{ds}{}^mC_{ks}A_{es}G_{ks}T_{es}T_k$ | 36 | 118 |
| 1341319 | 1781 | 1796 | 21596 | 21611 | TCTTATGTAATAGCCA | $T_{ks}{}^mC_{ks}T_{ds}T_{ds}A_{ds}T_{ds}G_{ds}T_{ds}A_{ds}A_{ds}T_{ds}A_{ks}G_{es}{}^mC_{ks}{}^mC_{es}A_k$ | 65 | 742 |

TABLE 51-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341322 | 2254 | 2269 | 22069 | 22084 | CAAGAGGATAGTCCAT | $^mC_{ks}A_{ks}A_{ds}G_{ds}A_{ds}G_{ds}G_{ds}A_{ds}T_{ds}A_{ds}G_{ds}T_{ks}{}^mC_{es}{}^mC_{ks}A_{es}T_k$ | 22 | 510 |
| 1341326 | 2245 | 2260 | 22060 | 22075 | AGTCCATGCAAAAGCA | $A_{ks}G_{ks}T_{ds}{}^mC_{ds}{}^mC_{ds}A_{ds}T_{ds}G_{ds}{}^mC_{ds}A_{ds}A_{ds}A_{ks}A_{es}G_{ks}{}^mC_{es}A_{sk}$ | 52 | 120 |
| 1341327 | 2191 | 2206 | 22006 | 22021 | GTCTTGATGTAGTGGG | $G_{ks}T_{ks}{}^MC_{ds}T_{ds}T_{ds}G_{ds}A_{ds}T_{ds}G_{ds}T_{ds}A_{ds}G_{ks}T_{es}G_{ks}G_{es}G_k$ | 18 | 1132 |
| 1341333 | N/A | N/A | 9518 | 9533 | CTACACTAATATTGAG | $^mC_{ks}T_{ks}A_{ds}{}^mC_{ds}A_{ds}{}^mC_{ds}T_{ds}A_{ds}A_{ds}T_{ds}A_{ds}T_{ks}T_{es}G_{ks}A_{es}G_k$ | 5 | 59 |
| 1341338 | 2355 | 2370 | 22170 | 22185 | TTATAACTACAAGAGG | $T_{ks}T_{ks}A_{ds}T_{ds}A_{ds}A_{ds}{}^mC_{ds}T_{ds}A_{ds}{}^mC_{ds}A_{ds}A_{ks}G_{es}G_{ks}G_{es}G_k$ | 55 | 1289 |
| 1341345 | N/A | N/A | 11853 | 11868 | AGCAGAATTGTGAACG | $A_{ks}G_{ks}{}^mC_{ds}A_{ds}G_{ds}A_{ds}A_{ds}T_{ds}T_{ds}G_{ds}T_{ds}G_{ks}A_{es}A_{ks}{}^mC_{es}G_k$ | 31 | 844 |
| 1341357 | N/A | N/A | 12421 | 12436 | TGGTAACGGTGATCAA | $T_{ks}G_{ks}G_{ds}T_{ds}A_{ds}A_{ds}{}^mC_{ds}G_{ds}G_{ds}T_{ds}G_{ds}A_{ks}T_{es}{}^mC_{ks}A_{es}A_k$ | 26 | 67 |
| 1341368 | N/A | N/A | 16131 | 16146 | GCTCCATAATAATAGC | $G_{ks}{}^mC_{ks}T_{ds}{}^mC_{ds}{}^mC_{ds}A_{ds}T_{ds}A_{ds}A_{ds}T_{ds}A_{ds}A_{ks}T_{es}A_{ks}G_{es}{}^mC_k$ | 15 | 2665 |
| 1341374 | N/A | N/A | 18099 | 18114 | CTGAAATTGATACACC | $^mC_{ks}T_{ks}G_{ds}A_{ds}A_{ds}A_{ds}T_{ds}T_{ds}G_{ds}A_{ds}T_{ds}A_{ks}{}^mC_{es}A_{ks}{}^mC_{es}{}^mC_k$ | 45 | 393 |
| 1341378 | N/A | N/A | 17991 | 18006 | GTTAGTATAGTTATCT | $G_{ks}T_{ks}T_{ds}A_{ds}G_{ds}T_{ds}A_{ds}T_{ds}A_{ds}G_{ds}T_{ds}T_{ks}A_{es}T_{ks}{}^mC_{es}T_k$ | 51 | 1171 |
| 1341381 | N/A | N/A | 19911 | 19926 | GCATCTTAAGATACCC | $G_{ks}{}^mC_{ks}A_{ds}T_{ds}{}^mC_{ds}T_{ds}T_{ds}A_{ds}A_{ds}G_{ds}A_{ds}T_{ks}A_{es}{}^mC_k{}^mC_{es}{}^mC_{sk}$ | 41 | 553 |
| 1341385 | N/A | N/A | 19907 | 19922 | CTTAAGATACCCAGGT | $^mC_{ks}T_{ks}T_{ds}A_{ds}A_{ds}G_{ds}A_{ds}T_{ds}A_{ds}{}^mC_{ds}{}^mC_{ds}{}^mC_{ks}A_{es}G_{ks}G_{es}T_k$ | 34 | 241 |
| 1341390 | N/A | N/A | 20114 | 20129 | GCATCAAGACATTCTA | $G_{ks}{}^mC_{ks}A_{ds}T_{ds}{}^mC_{ds}A_{ds}A_{ds}G_{ds}A_{ds}{}^mC_{ds}A_{ds}T_{ks}T_{es}{}^mC_{ks}T_{es}A_k$ | 43 | 1565 |
| 1341398 | N/A | N/A | 20194 | 20209 | TTGCAGTTATTAGAAG | $T_{ks}T_{ks}G_{ds}{}^mC_{ds}A_{ds}G_{ds}T_{ds}T_{ds}A_{ds}T_{ds}T_{ds}A_{ks}G_{es}A_{ks}A_{es}G_k$ | 27 | 2123 |
| 1341403 | N/A | N/A | 12801 | 12816 | AGGCTGTAAGAGTCAG | $A_{ks}G_{ds}G_{ds}{}^mC_{ds}T_{ds}G_{ds}T_{ds}A_{ds}A_{ds}G_{ds}A_{ds}G_{ks}T_{es}{}^mC_{ks}A_{es}G_k$ | 38 | 2809 |
| 1341405 | N/A | N/A | 12501 | 12516 | GCAGAAATTCACCTTG | $G_{ks}{}^mC_{ks}A_{ds}G_{ds}A_{ds}A_{ds}A_{ds}T_{ds}T_{ds}{}^mC_{ds}A_{ds}{}^mC_{ks}{}^mC_{es}T_{ks}T_{es}G_k$ | 53 | 1002 |
| 1341409 | N/A | N/A | 20422 | 20437 | ACAGTAAAATTATGCC | $A_{ks}{}^mC_{ks}A_{ds}G_{ds}T_{ds}A_{ds}A_{ds}A_{ds}A_{ds}T_{ds}T_{ds}A_{ks}T_{es}G_{ks}{}^mC_{es}{}^mC_k$ | 28 | 477 |
| 1341411 | N/A | N/A | 14194 | 14209 | TGTGATTGAGTTCTCC | $T_{ks}G_{ks}T_{ds}G_{ds}A_{ds}T_{ds}T_{ds}G_{ds}A_{ds}G_{ds}T_{ds}T_{ks}{}^mC_{es}T_{ks}{}^mC_{es}{}^mC_k$ | 11 | 2020 |

TABLE 51-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341414 | N/A | N/A | 14168 | 14183 | ATAGCAAGCCAACAGA | $A_{ks}T_{ks}A_{ds}G_{ds}{}^mC_{ds}A_{ds}$ $G_{ds}{}^mC_{s}{}^mC_{ds}A_{ds}A_{ks}{}^mC_{es}$ $A_{ks}G_{es}A_k$ | 23 | 2633 |
| 1341528 | 1075 | 1090 | 20890 | 20905 | GTGCCAAACCAATGTT | $G_{ks}T_{ks}G_{ds}{}^mC_{ds}{}^mC_{ds}A_{ds}$ $A_{ds}A_{ds}{}^mC_{ds}{}^mC_{ds}A_{ds}A_{ks}$ $T_{es}G_{ks}T_{es}T_k$ | 38 | 1042 |
| 1341536 | 801 | 816 | 15682 | 15697 | GTATTCCATCTATCAG | $G_{ks}T_{ks}A_{ds}T_{ds}T_{ds}{}^mC_{ds}$ $^mC_{ds}A_{ds}T_{ds}{}^mC_{ds}T_{ds}A_{ks}$ $T_{es}{}^mC_{ks}A_{es}G_k$ | 48 | 727 |
| 1341537 | 791 | 806 | 15672 | 15687 | TATCAGACTTCTTACG | $T_{ks}A_{ks}T_{ds}{}^mC_{ds}A_{ds}G_{ds}A_{ds}$ $^mC_{ds}T_{ds}T_{ds}{}^mC_{ds}T_{ks}T_{es}$ $A_{ks}{}^mC_{es}G_k$ | 32 | 103 |
| 1341542 | 1319 | 1334 | 21134 | 21149 | TTGAACAGTCTTAAAC | $T_{ks}T_{ks}G_{ds}A_{ds}A_{ds}{}^MC_{ds}A_{ds}$ $G_{ds}T_{ds}{}^mC_{ds}T_{ds}T_{ks}A_{es}A_{ks}$ $A_{es}{}^mC_k$ | 37 | 422 |
| 1341544 | 1264 | 1279 | 21079 | 21094 | GGGAGGTAGCTTTTGT | $G_lC_sG_lC_sG_{ds}A_{ds}G_{ds}G_{ds}$ $T_{ds}A_{ds}G_{ds}{}^mC_{ds}T_{ds}T_{ks}T_{es}$ $T_{ks}G_{es}T_k$ | 66 | 343 |
| 1341548 | 1384 | 1399 | 21199 | 21214 | TAGCTGTGCACTCATT | $T_{ks}A_{ks}G_{ds}{}^mC_{ds}T_{ds}G_{ds}T_{ds}$ $G_{ds}{}^mC_{ds}A_{ds}{}^mC_{ds}T_{ks}{}^mC_{es}$ $A_{ks}T_{es}T_k$ | 53 | 1981 |
| 1341550 | 1398 | 1413 | 21213 | 21228 | GAAACTTGATCTCTTA | $G_{ks}A_{ks}A_{ds}A_{ds}{}^mC_{ds}T_{ds}T_{ds}$ $G_{ds}A_{ds}T_{ds}{}^mC_{ds}T_{ks}{}^mC_{es}$ $T_{ks}T_{es}A_k$ | 54 | 2717 |
| 1341553 | 1346 | 1361 | 21161 | 21176 | TGGCATGGCTACAGAT | $T_{ks}G_{ks}G_{ds}{}^mC_{ds}A_{ds}T_{ds}G_{ds}$ $G_{ds}{}^mC_{ds}T_{ds}A_{ds}{}^mC_{ks}A_{es}$ $G_{ks}A_{es}T_k$ | 58 | 423 |
| 1341559 | 1488 | 1503 | 21303 | 21318 | GTTTTGGGCTAATGAA | $G_{ks}T_{ks}T_{ds}T_{ds}T_{ds}G_{ds}G_{ds}$ $G_{ds}{}^mC_{ds}T_{ds}A_{ds}A_{ks}T_{es}G_{ks}$ $A_{es}A_k$ | 42 | 1204 |
| 1341562 | 1496 | 1511 | 21311 | 21326 | GTTGCACCGTTTTGGG | $G_{ks}T_{ks}T_{ds}G_{ds}{}^mC_{ds}A_{ds}$ $^mC_{ds}{}^mC_{ds}G_{ds}T_{ds}T_{ds}T_{ks}$ $T_{es}G_{ks}G_{es}G_k$ | 35 | 1827 |
| 1341571 | 1717 | 1732 | 21532 | 21547 | TCTAAACATCTCTGGG | $T_{ks}{}^mC_{ks}T_{ds}A_{ds}A_{ds}A_{ds}$ $^mC_{ds}A_{ds}T_{ds}{}^mC_{ds}T_{ds}{}^mC_{ks}$ $T_{es}G_{ks}G_{es}G_k$ | 21 | 2287 |
| 1341586 | 2184 | 2199 | 21999 | 22014 | TGTAGTGGGAGTCGGA | $T_{ks}G_{ks}T_{ds}A_{ds}G_{ds}T_{ds}G_{ds}$ $G_{ds}G_{ds}A_{ds}G_{ds}T_{ks}{}^mC_{es}G_{ks}$ $G_{es}A_k$ | 27 | 587 |
| 1341587 | 1726 | 1741 | 21541 | 21556 | CTAAAATTGTCTAAAC | $^mC_{ks}T_{ks}A_{ds}A_{ds}A_{ds}A_{ds}T_{ds}$ $T_{ds}G_{ds}T_{ds}{}^mC_{ds}T_{ks}A_{es}A_{ks}$ $A_{es}{}^mC_k$ | 19 | 2590 |
| 1341590 | N/A | N/A | 9337 | 9352 | CCTCGATCCTATATAC | $^mC_{ks}{}^mC_{ks}T_{ds}{}^mC_{ds}G_{ds}A_{ds}$ $T_{ds}{}^mC_{ds}{}^mC_{ds}T_{ds}A_{ds}T_{ks}$ $A_{es}T_{ks}A_{es}{}^mC_k$ | 3 | 2812 |
| 1341593 | N/A | N/A | 9961 | 9976 | TAAGCTGAGAGTTCTA | $T_{ks}A_{ks}A_{ds}G_{ds}{}^mC_{ds}T_{ds}G_{ds}$ $A_{ds}G_{ds}A_{ds}G_{ds}T_{ks}T_{es}{}^mC_{ks}$ $T_{es}A_k$ | 29 | 2499 |
| 1341594 | N/A | N/A | 11568 | 11583 | TGACAATGGTTGATAG | $T_{ks}G_{ks}A_{ds}{}^mC_{ds}A_{ds}A_{ds}T_{ds}$ $G_{ds}G_{ds}T_{ds}T_{ds}G_{ks}A_{es}T_{ks}$ $A_{es}G_k$ | 37 | 1700 |
| 1341597 | N/A | N/A | 9971 | 9986 | TTGAGTAGTGTAAGCT | $T_{ks}T_{ks}G_{ds}A_{ds}G_{ds}T_{ds}A_{ds}$ $G_{ds}T_{ds}G_{ds}T_{ds}A_{ks}A_{es}G_{ks}$ $^mC_{es}T_k$ | 29 | 2346 |

TABLE 51-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341598 | N/A | N/A | 16282 | 16297 | TAGTCTTCAGCAAAGT | $T_{ks}A_{ks}G_{ds}T_{ds}{}^mC_{ds}T_{ds}T_{ds}$ ${}^mC_{ds}A_{ds}G_{ds}{}^mC_{ds}A_{ks}A_{es}$ $A_{ks}G_{es}T_k$ | 35 | 2632 |
| 1341599 | N/A | N/A | 16377 | 16392 | ACCAAACTTCCAGCAG | $A_{ks}{}^mC_{ks}{}^mC_{ds}A_{ds}A_{ds}A_{ds}$ ${}^mC_{ds}T_{ds}T_{ds}{}^mC_{ds}{}^mC_{ds}A_{ks}$ $G_{es}{}^mC_{ks}A_{es}G_k$ | 32 | 1948 |
| 1341605 | N/A | N/A | 15491 | 15506 | TTAATGCCACCCTACC | $T_{ks}T_{ks}A_{ds}A_{ds}T_{ds}G_{ds}{}^mC_{ds}$ ${}^mC_{ds}A_{ds}{}^mC_{ds}{}^mC_{ds}{}^mC_{ks}T_{es}$ $A_{ks}{}^mC_{es}{}^mC_k$ | 11 | 2304 |
| 1341606 | N/A | N/A | 14204 | 14219 | CAGATTATTATGTGAT | ${}^mC_{ks}A_{ks}G_{ds}A_{ds}T_{ds}T_{ds}A_{ds}$ $T_{ds}T_{ds}A_{ds}T_{ds}G_{ks}T_{es}G_{ks}$ $A_{es}T_k$ | 31 | 2723 |
| 1341609 | N/A | N/A | 17986 | 18001 | TATAGTTATCTTCTCA | $T_{ks}A_{ks}T_{ds}A_{ds}G_{ds}T_{ds}T_{ds}$ $A_{ds}T_{ds}{}^mC_{ds}T_{ds}T_{ks}{}^mC_{es}{}^m$ $T_{ks}{}^mC_{es}A_k$ | 45 | 2295 |
| 1341616 | N/A | N/A | 17996 | 18011 | ATGAAGTTAGTATAGT | $A_{ks}T_{ks}G_{ds}A_{ds}A_{ds}G_{ds}T_{ds}$ $T_{ds}A_{ds}G_{ds}T_{ds}A_{ks}T_{es}A_{ks}$ $G_{es}T_k$ | 34 | 1483 |

TABLE 52

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1245927 | N/A | N/A | 3433 | 3448 | AGTAGATGGTAAGTCA | $A_{ks}G_{ks}T_{ks}A_{ds}G_{ds}A_{ds}T_{ds}G_{ds}$ $G_{ds}T_{ds}A_{ds}A_{ds}G_{ds}T_{ks}{}^mC_{ks}A_k$ | 79 | 121 |
| 1246023 | N/A | N/A | 5046 | 5061 | GAGTGAATCATTCAGT | $G_{ks}A_{ks}G_{ks}T_{ds}G_{ds}A_{ds}A_{ds}T_{ds}$ ${}^mC_{ds}A_{ds}T_{ds}T_{ds}{}^mC_{ds}A_{ks}G_{ks}$ $T_k$ | 89 | 1526 |
| 1341650 | 1264 | 1279 | 21079 | 21094 | GGGAGGTAGCTTTTGT | $G_{ks}G_{ks}G_{ks}A_{ds}G_{ys}G_{ds}T_{ds}A_{ds}$ $G_{ds}{}^mC_{ds}T_{ds}T_{ds}T_{ds}T_{ks}G_{ks}T_k$ | 17 | 343 |
| 1341653 | 1316 | 1331 | 21131 | 21146 | AACAGTCTTAAACCTT | $A_{ks}A_{ks}{}^mC_{ds}A_{ds}G_{ys}T_{ds}{}^mC_{ds}$ $T_{ds}T_{ds}A_{ds}A_{ds}A_{ds}{}^mC_{ds}{}^mC_{ks}$ $T_{ks}T_k$ | 75 | 188 |
| 1341660 | 1328 | 1343 | 21143 | 21158 | GAATGCTACTTGAACA | $G_{ks}A_{ks}A_{ks}T_{ds}G_{ys}{}^mC_{ds}T_{ds}$ $A_{ds}{}^mC_{ds}T_{ds}T_{ds}G_{ds}A_{ds}A_{ks}$ ${}^mC_{ks}A_k$ | 48 | 1123 |
| 1341664 | 1320 | 1335 | 21135 | 21150 | CTTGAACAGTCTTAAA | ${}^mC_{ks}T_{ks}T_{ks}G_{ds}A_{ys}A_{ds}{}^mC_{ds}$ $A_{ds}G_{ds}T_{ds}{}^mC_{ds}T_{ds}T_{ds}A_{ks}$ $A_{ks}A_k$ | 49 | 500 |
| 1341667 | 1312 | 1327 | 21127 | 21142 | GTCTUAAACCTTCCCT | $G_{ks}T_{ks}{}^mC_{ks}T_{ds}U_{ys}A_{ds}A_{ds}$ $A_{ds}{}^mC_{ds}{}^mC_{ds}T_{ds}T_{ds}{}^mC_{ds}$ ${}^mC_{ks}{}^mC_{ks}T_k$ | 35 | 2968 |
| 1341670 | 1333 | 1348 | 21148 | 21163 | GATTGGAATGCTACTT | $G_{ks}A_{ks}T_{ks}T_{ds}G_{ys}G_{ds}A_{ds}A_{ds}$ $T_{ds}G_{ds}{}^mC_{ds}T_{ds}A_{ds}{}^mC_{ks}T_{ks}$ $T_k$ | 48 | 1435 |
| 1341676 | 1324 | 1339 | 21139 | 21154 | GCTACTTGAACAGTCT | $G_{ks}{}^mC_{ks}T_{ks}A_{ds}C_{ys}T_{ds}T_{ds}$ $G_{ds}A_{ds}A_{ds}{}^mC_{ds}A_{ds}G_{ds}T_{ks}$ ${}^mC_{ks}T_k$ | 82 | 811 |

TABLE 52-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341678 | 1356 | 1371 | 21171 | 21186 | TGATATTCTGTGGCAT | $T_{ks}G_{ks}A_{ks}T_{ds}A_{ys}T_{ds}T_{ds}{}^mC_{ds}T_{ds}G_{ds}T_{ds}G_{ds}G_{ds}{}^mC_{ks}A_{ks}T_k$ | 61 | 1124 |
| 1341680 | 1347 | 1362 | 21162 | 21177 | GTGGCATGGCTACAGA | $G_{iss}T_{ks}G_{iss}G_{ds}{}^mC_{ys}A_{ds}T_{ds}G_{ds}G_{ds}{}^mC_{ds}T_{ds}A_{ds}{}^mC_{ds}A_{ks}G_{ks}A_k$ | 49 | 501 |
| 1341683 | 1340 | 1355 | 21155 | 21170 | GGCTACAGATTGGAAT | $G_{ks}G_{ks}{}^mC_{ks}T_{ds}A_{ys}{}^mC_{ds}A_{ds}G_{ds}A_{ds}T_{ds}T_{ds}G_{ds}G_{ds}A_{ks}A_{ks}T_k$ | 40 | 1980 |
| 1341690 | 1364 | 1379 | 21179 | 21194 | GTTCUTGTTGATATTC | $G_{ks}T_{ks}T_{ks}{}^mC_{ds}U_{ys}T_{ds}G_{ds}T_{ds}T_{ds}G_{ds}A_{ds}T_{ds}A_{ds}T_{ks}T_{ks}{}^mC_k$ | 70 | 2969 |
| 1341696 | 1352 | 1367 | 21167 | 21182 | ATTCUGTGGCATGGCT | $A_{ks}T_{ks}T_{ks}{}^mC_{ds}U_{ys}G_{ds}T_{ds}G_{ds}G_{ds}{}^mC_{ds}A_{ds}T_{ds}G_{ds}G_{ks}{}^mC_{ks}T_k$ | 59 | 2970 |
| 1341699 | 1387 | 1402 | 21202 | 21217 | TCTTAGCTGTGCACTC | $T_{ks}{}^mC_{ks}T_{ks}T_{ds}A_{ys}G_{ds}{}^mC_{ds}T_{ds}G_{ds}T_{ds}G_{ds}{}^mC_{ds}A_{ds}{}^mC_{ks}T_{ks}{}^mC_k$ | 71 | 190 |
| 1341705 | 1393 | 1408 | 21208 | 21223 | TTGAUCTCTTAGCTGT | $T_{ks}T_{ks}G_{ks}A_{ds}U_{ys}{}^mC_{ds}T_{ds}{}^mC_{ds}T_{ds}T_{ds}A_{ds}G_{ds}{}^mC_{ds}T_{ks}G_{ks}T_k$ | 50 | 2971 |
| 1341711 | 1420 | 1435 | 21235 | 21250 | GGTTGAGATAAAGCTG | $G_{ks}G_{ks}T_{ks}T_{ds}G_{ys}A_{ds}G_{ds}A_{ds}T_{ds}A_{ds}A_{ds}A_{ds}G_{ds}{}^mC_{ks}T_{ks}G_k$ | 57 | 1826 |
| 1341714 | 1425 | 1440 | 21240 | 21255 | GTCCAGGTTGAGATAA | $G_{ks}T_{ks}{}^mC_{ks}{}^mC_{ds}A_{ys}G_{ds}G_{ds}T_{ds}T_{ds}G_{ds}A_{ds}G_{ds}A_{ds}T_{ks}A_{ks}A_k$ | 68 | 113 |
| 1341718 | 1461 | 1476 | 21276 | 21291 | CTAGGGAAATCTTTCA | ${}^mC_{ks}T_{ks}A_{ks}G_{ds}G_{ys}G_{ds}A_{ds}A_{ds}A_{ds}T_{ds}{}^mC_{ds}T_{ds}T_{ds}T_{ks}{}^mC_{ks}A_k$ | 19 | 659 |
| 1341721 | 693 | 708 | 12111 | 12126 | ATGAGGTTTTGATACC | $A_{ks}T_{ks}G_{ks}A_{ds}G_{ys}G_{ds}T_{ds}T_{ds}T_{ds}T_{ds}G_{ds}A_{ds}T_{ds}A_{ks}{}^mC_{ks}{}^mC_k$ | 49 | 569 |
| 1341725 | 1415 | 1430 | 21230 | 21245 | AGATAAAGCTGCCTGC | $A_{ks}G_{ks}A_{ks}T_{ds}A_{ys}A_{ds}A_{ds}G_{ds}{}^mC_{ds}T_{ds}G_{ds}{}^mC_{ds}{}^mC_{ds}T_{ks}G_{ks}{}^mC_k$ | 35 | 1515 |
| 1341728 | 1489 | 1504 | 21304 | 21319 | CGTTUTGGGCTAATGA | ${}^mC_{ks}G_{ks}T_{ks}T_{ds}U_{ys}T_{ds}G_{ds}G_{ds}G_{ds}{}^mC_{ds}T_{ds}A_{ds}A_{ds}T_{ks}G_{ks}A_k$ | 34 | 2972 |
| 1341731 | 1497 | 1512 | 21312 | 21327 | AGTTGCACCGTTTTGG | $A_{ks}G_{ks}T_{ks}T_{ds}G_{ys}{}^mC_{ds}A_{ds}{}^mC_{ds}{}^mC_{ds}G_{ds}T_{ds}T_{ds}T_{ds}T_{ks}G_{ks}G_k$ | 38 | 1905 |
| 1341736 | 1493 | 1508 | 21308 | 21323 | GCACCGTTTTGGGCTA | $G_{ks}{}^mC_{ks}A_{ks}{}^mC_{ds}{}^mC_{ys}G_{ds}T_{ds}T_{ds}T_{ds}T_{ds}G_{ds}G_{ds}G_{ds}{}^mC_{ks}T_{ks}A_k$ | 67 | 1593 |
| 1341738 | 1622 | 1637 | 21437 | 21452 | AGAGUCGGTCACCTTT | $A_{ks}G_{ks}A_{ks}G_{ds}U_{ys}{}^mC_{ds}G_{ds}G_{ds}T_{ds}{}^mC_{ds}A_{ds}{}^mC_{ds}{}^mC_{ks}T_{ks}T_k$ | 55 | 2973 |
| 1341744 | 1504 | 1519 | 21319 | 21334 | AGAAUAGAGTTGCACC | $A_{ks}G_{ks}A_{ks}A_{ds}U_{ys}A_{ds}G_{ds}A_{ds}G_{ds}T_{ds}T_{ds}G_{ds}{}^mC_{ds}A_{ks}{}^mC_{ks}{}^mC_k$ | 49 | 2974 |
| 1341748 | 1614 | 1629 | 21429 | 21444 | TCACCTTTCATAATGT | $T_{ks}{}^mC_{ks}A_{ks}{}^mC_{ds}{}^mC_{ys}T_{ds}T_{ds}T_{ds}{}^mC_{ds}A_{ds}T_{ds}A_{ds}A_{ds}T_{ks}G_{ks}T_k$ | 47 | 2109 |
| 1341754 | 1618 | 1633 | 21433 | 21448 | TCGGUCACCTTTCATA | $T_{ks}{}^mC_{ks}G_{ks}G_{ds}U_{ys}{}^mC_{ds}A_{ds}{}^mC_{ds}{}^mC_{ds}T_{ds}T_{ds}T_{ds}{}^mC_{ds}A_{ks}T_{ks}A_k$ | 21 | 2975 |

TABLE 52-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341761 | 1630 | 1645 | 21445 | 21460 | TTTAAAATAGAGTCGG | $T_{ks}T_{ks}T_{ks}A_{ds}A_{ys}A_{ds}A_{ds}T_{ds}A_{ds}G_{ds}A_{ds}G_{ds}T_{ds}{}^mC_{ks}G_{ks}G_k$ | 77 | 1051 |
| 1341764 | 1626 | 1641 | 21441 | 21456 | AAATAGAGTCGGTCAC | $A_{ks}A_{ks}A_{ks}T_{ds}A_{ys}G_{ds}A_{ds}G_{ds}T_{ds}{}^mC_{ds}G_{ds}G_{ds}T_{ds}{}^mC_{ks}A_{ks}{}^mC_k$ | 63 | 740 |
| 1341767 | 1714 | 1729 | 21529 | 21544 | AAACATCTCTGGGACC | $A_{ks}A_{ks}A_{ks}{}^mC_{ds}A_{ys}T_{ds}{}^mC_{ds}T_{ds}{}^mC_{ds}T_{ds}G_{ds}G_{ds}G_{ds}A_{ks}{}^mC_{ks}{}^mC_k$ | 66 | 2129 |
| 1341768 | 1710 | 1725 | 21525 | 21540 | ATCTCTGGGACCAAGG | $A_{ks}T_{ks}{}^mC_{ks}T_{ds}C_{ys}T_{ds}G_{ds}G_{ds}G_{ds}A_{ds}{}^mC_{ds}{}^mC_{ds}A_{ds}A_{ks}G_{ks}G_k$ | 52 | 37 |
| 1341773 | 1718 | 1733 | 21533 | 21548 | GTCTAAACATCTCTGG | $G_{ks}T_{ks}{}^mC_{ks}T_{ds}A_{ys}A_{ds}A_{ds}{}^mC_{ds}A_{ds}T_{ds}{}^mC_{ds}T_{ds}{}^mC_{ds}T_{ks}G_{ks}G_k$ | 47 | 429 |
| 1341781 | 1768 | 1783 | 21583 | 21598 | CCAGUACAGTTCCTTT | ${}^mC_{ks}{}^mC_{ks}A_{ks}G_{ds}U_{ys}A_{ds}{}^mC_{ds}A_{ds}G_{ds}T_{ds}T_{ds}{}^mC_{ds}{}^mC_{ks}T_{ks}T_k$ | 51 | 2976 |
| 1341783 | 1750 | 1765 | 21565 | 21580 | CTGTGTTAGCTTTAAT | ${}^mC_{ks}T_{ks}G_{ks}T_{ds}G_{ys}T_{ds}T_{ds}A_{ds}G_{ds}{}^mC_{ds}T_{ds}T_{ds}T_{ds}A_{ks}A_{ks}T_k$ | 41 | 1286 |
| 1341787 | 794 | 809 | 15675 | 15690 | ATCTATCAGACTTCTT | $A_{ks}T_{ks}{}^mC_{ks}T_{ds}A_{ys}T_{ds}{}^mC_{ds}A_{ds}G_{ds}A_{ds}{}^mC_{ds}T_{ds}T_{ds}{}^mC_{ks}T_{ks}T_k$ | 34 | 2728 |
| 1341789 | 1778 | 1793 | 21593 | 21608 | TATGUAATAGCCAGTA | $T_{ks}A_{ks}T_{ks}G_{ds}U_{ys}A_{ds}A_{ds}T_{ds}A_{ds}G_{ds}{}^mC_{ds}{}^mC_{ds}A_{ds}G_{ks}T_{ks}A_k$ | 43 | 2977 |
| 1341792 | 1774 | 1789 | 21589 | 21604 | TAATAGCCAGTACAGT | $T_{ks}A_{ks}A_{ks}T_{ds}A_{ys}G_{ds}{}^mC_{ds}{}^mC_{ds}A_{ds}G_{ds}T_{ds}A_{ds}{}^mC_{ds}A_{ks}G_{ks}T_k$ | 51 | 196 |
| 1341801 | 2186 | 2201 | 22001 | 22016 | GATGUAGTGGGAGTCG | $G_{ks}A_{ks}T_{ks}G_{ds}U_{ys}A_{ds}G_{ds}T_{ds}G_{ds}G_{ds}G_{ds}A_{ds}G_{ds}T_{ks}{}^mC_{ks}G_k$ | 35 | 2978 |
| 1341806 | 2193 | 2208 | 22008 | 22023 | TAGTCTTGATGTAGTG | $T_{ks}A_{ks}G_{ks}T_{ds}C_{ys}T_{ds}T_{ds}G_{ds}A_{ds}T_{ds}G_{ds}T_{ds}A_{ds}G_{ks}T_{ks}G_k$ | 56 | 1288 |
| 1341807 | 1782 | 1797 | 21597 | 21612 | TTCTUATGTAATAGCC | $T_{ks}T_{ks}{}^mC_{ks}T_{ds}U_{ys}A_{ds}T_{ds}G_{ds}T_{ds}A_{ds}A_{ds}T_{ds}A_{ds}G_{ks}{}^mC_{ks}{}^mC_k$ | 66 | 2979 |
| 1341816 | 2257 | 2272 | 22072 | 22087 | AAACAAGAGGATAGTC | $A_{ks}A_{ks}A_{ks}{}^mC_{ds}A_{ys}A_{ds}G_{ds}A_{ds}G_{ds}G_{ds}A_{ds}T_{ds}A_{ds}G_{ks}T_{ks}{}^mC_k$ | 53 | 744 |
| 1341817 | 2247 | 2262 | 22062 | 22077 | ATAGUCCATGCAAAAG | $A_{ks}T_{ks}A_{ks}G_{ds}U_{ys}{}^mC_{ds}{}^mC_{ds}A_{ds}T_{ds}G_{ds}{}^mC_{ds}A_{ds}A_{ds}A_{ks}A_{ks}G_k$ | 57 | 2980 |
| 1341820 | N/A | N/A | 9511 | 9526 | AATAUTGAGGCACTGG | $A_{ks}A_{ks}T_{ks}A_{ds}U_{ys}T_{ds}G_{ds}A_{ds}G_{ds}G_{ds}{}^mC_{ds}A_{ds}{}^mC_{ds}T_{ks}G_{ks}G_k$ | 48 | 2981 |
| 1341827 | N/A | N/A | 9330 | 9345 | CCTAUATACATCCAAG | ${}^mC_{ks}{}^mC_{ks}T_{ks}A_{ds}U_{ys}A_{ds}T_{ds}A_{ds}{}^mC_{ds}A_{ds}T_{ds}{}^mC_{ds}{}^mC_{ds}A_{ks}A_{ks}G_k$ | 39 | 2982 |
| 1341830 | N/A | N/A | 9598 | 9613 | ATGTGAAGAGCTGGTA | $A_{ks}T_{ks}G_{ks}T_{ds}G_{ys}A_{ds}A_{ds}G_{ds}A_{ds}G_{ds}{}^mC_{ds}T_{ds}G_{ds}G_{ks}T_{ks}A_k$ | 26 | 527 |
| 1341832 | N/A | N/A | 9964 | 9979 | GTGTAAGCTGAGAGTT | $G_{ks}T_{ks}G_{ks}T_{ds}A_{ys}A_{ds}G_{ds}{}^mC_{ds}T_{ds}G_{ds}A_{ds}G_{ds}A_{ds}G_{ks}T_{ks}T_k$ | 55 | 2760 |

TABLE 52-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341840 | N/A | N/A | 11543 | 11558 | TGACAATGGTTGCCAC | $T_{ks}G_{ks}A_{ks}{}^mC_{ds}A_{ys}A_{ds}T_{ds}G_{ds}G_{ds}T_{ds}T_{ds}G_{ds}{}^mC_{ds}{}^mC_{ks}A_{ks}{}^mC_k$ | 55 | 1233 |
| 1341842 | N/A | N/A | 11548 11573 | 11563 11588 | TCTCUTGACAATGGTT | $T_{ks}{}^mC_{ks}T_{ks}{}^mC_{ds}U_{ys}T_{ds}G_{ds}A_{ds}{}^mC_{ds}A_{ds}A_{ds}T_{ds}G_{ds}G_{ks}T_{ks}T_k$ | 62 | 2983 |
| 1341845 | N/A | N/A | 11858 | 11873 | GATTAAGCAGAATTGT | $G_{ks}A_{ks}T_{ds}T_{ds}A_{ys}A_{ds}G_{ds}{}^mC_{ds}A_{ds}G_{ds}A_{ds}A_{ds}T_{ds}T_{ks}G_{ks}T_k$ | 28 | 1156 |
| 1341847 | 805 | 820 | 15686 | 15701 | GTAAGTATTCCATCTA | $G_{ks}T_{ks}A_{ks}A_{ds}G_{ys}T_{ds}A_{ds}T_{ds}T_{ds}{}^mC_{ds}{}^mC_{ds}A_{ds}T_{ds}{}^mC_{ks}T_{ks}A_k$ | 43 | 1038 |
| 1341851 | N/A | N/A | 14196 | 14211 | TATGUGATTGAGTTCT | $T_{ks}A_{ks}T_{ks}G_{ds}U_{ys}G_{ds}A_{ds}T_{ds}T_{ds}G_{ds}A_{ds}G_{ds}T_{ds}T_{ks}{}^mC_{ks}T_k$ | 21 | 2984 |
| 1341853 | N/A | N/A | 12416 | 12431 | ACGGUGATCAAATGTA | $A_{ks}{}^mC_{ks}G_{ks}G_{ds}U_{ys}G_{ds}A_{ds}T_{ds}{}^mC_{ds}A_{ds}A_{ds}A_{ds}T_{ds}G_{ks}T_{ks}A_k$ | 18 | 2985 |
| 1341855 | N/A | N/A | 12426 | 12441 | CAGGGTGGTAACGGTG | $^mC_{ks}A_{ks}G_{ds}G_{ds}G_{ys}T_{ds}G_{ds}G_{ds}T_{ds}A_{ds}A_{ds}{}^mC_{ds}G_{ds}G_{ks}T_{ks}G_k$ | 29 | 2729 |
| 1341860 | N/A | N/A | 16134 | 16149 | GATGCTCCATAATAAT | $G_{ks}A_{ks}T_{ds}G_{ds}C_{ys}T_{ds}{}^mC_{ds}{}^mC_{ds}A_{ds}T_{ds}A_{ds}A_{ds}T_{ds}A_{ks}A_{ks}T_k$ | 24 | 2049 |
| 1341861 | N/A | N/A | 14914 | 14929 | ACATUAGCAAGCTAAG | $A_{ks}{}^mC_{ks}A_{ks}T_{ds}U_{ys}A_{ds}G_{ds}{}^mC_{ds}A_{ds}A_{ds}G_{ds}{}^mC_{ds}T_{ds}A_{ks}A_{ks}G_k$ | 23 | 2986 |
| 1341862 | N/A | N/A | 15494 | 15509 | GCATUAATGCCACCCT | $G_{ks}{}^mC_{ks}A_{ks}T_{ds}U_{ys}A_{ds}A_{ds}T_{ds}G_{ds}{}^mC_{ds}{}^mC_{ds}A_{ds}{}^mC_{ds}{}^mC_{ks}{}^mC_{ks}T_k$ | 32 | 2987 |
| 1341870 | N/A | N/A | 16287 | 16302 | TAGAATAGTCTTCAGC | $T_{ks}A_{ks}G_{ds}A_{ds}A_{ys}T_{ds}A_{ds}G_{ds}T_{ds}{}^mC_{ds}T_{ds}T_{ds}{}^mC_{ds}A_{ks}G_{ks}{}^mC_k$ | 30 | 1403 |
| 1341877 | N/A | N/A | 16124 | 16139 | AATAATAGCTCTATTG | $A_{ks}A_{ks}T_{ks}A_{ds}A_{ys}T_{ds}A_{ds}G_{ds}{}^mC_{ds}T_{ds}{}^mC_{ds}T_{ds}A_{ds}T_{ks}T_{ks}G_k$ | 16 | 2410 |
| 1341882 | N/A | N/A | 17992 | 18007 | AGTTAGTATAGTTATC | $AG_{ks}T_{ks}T_{ds}A_{ys}G_{ds}T_{ds}A_{ds}T_{ds}A_{ds}G_{ds}T_{ds}T_{ks}A_{ks}T_{ks}{}^mC_k$ | 42 | 1249 |
| 1341887 | N/A | N/A | 16380 | 16395 | CCAACCAAACTTCCAG | $^mC_{ks}{}^mC_{ks}A_{ks}A_{ds}C_{ys}{}^mC_{ds}A_{ds}A_{ds}A_{ds}{}^mC_{ds}T_{ds}T_{ds}{}^mC_{ds}{}^mC_{ks}A_{ks}G_k$ | 30 | 2539 |
| 1341889 | N/A | N/A | 17987 | 18002 | GTATAGTTATCTTCTC | $G_{ks}T_{ks}A_{ks}T_{ds}A_{ys}G_{ds}T_{ds}T_{ds}A_{ds}T_{ds}{}^mC_{ds}T_{ds}T_{ds}{}^mC_{ks}T_{ks}{}^mC_k$ | 54 | 937 |
| 1341890 | 1082 | 1097 | 20897 | 20912 | GCTGCTAGTGCCAAAC | $G_{ks}{}^mC_{ks}T_{ks}G_{ds}C_{ys}T_{ds}A_{ds}G_{ds}T_{ds}G_{ds}{}^mC_{ds}{}^mC_{ds}A_{ds}A_{ks}A_{ks}{}^mC_k$ | 39 | 1587 |
| 1341895 | N/A | N/A | 18099 | 18114 | CTGAAATTGATACACC | $^mC_{ks}T_{ks}G_{ds}A_{ds}A_{ys}A_{ds}T_{ds}T_{ds}G_{ds}A_{ds}T_{ds}A_{ds}{}^mC_{ds}A_{ks}{}^mC_{ks}{}^mC_k$ | 71 | 393 |
| 1341896 | N/A | N/A | 17997 | 18012 | TATGAAGTTAGTATAG | $T_{ks}A_{ks}T_{ks}G_{ds}A_{ys}A_{ds}G_{ds}T_{ds}T_{ds}A_{ds}G_{ds}T_{ds}A_{ds}T_{ks}A_{ks}G_k$ | 27 | 1560 |
| 1341900 | N/A | N/A | 19911 | 19926 | GCATCTTAAGATACCC | $G_{ks}{}^mC_{ks}A_{ks}T_{ds}C_{ys}T_{ds}T_{ds}A_{ds}A_{ds}G_{ds}A_{ds}T_{ds}A_{ds}{}^mC_{ks}{}^mC_{ks}{}^mC_k$ | 65 | 553 |

TABLE 52-continued

Inhibition of HSD17B13 RNA by modified oligonucleotides targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | Chemistry Notation (5' to 3') | % inhibition | SEQ ID NO |
|---|---|---|---|---|---|---|---|---|
| 1341907 | N/A | N/A | 18697 | 18712 | CAAAAGACTTTGAGAC | $^mC_{ks}A_{ks}A_{ks}A_{ds}A_{ys}G_{ds}A_{ds}$ $^mC_{ds}T_{ds}T_{ds}T_{ds}G_{ds}A_{ds}G_{ks}$ $A_{ks}{}^mC_k$ | 25 | 2186 |
| 1341908 | N/A | N/A | 19915 | 19930 | GAGTGCATCTTAAGAT | $G_{ks}A_{ks}G_{ks}T_{ds}G_{ys}{}^mC_{ds}A_{ds}$ $T_{ds}{}^mC_{ds}T_{ds}T_{ds}A_{ds}A_{ds}G_{ks}$ $A_{ks}T_k$ | 7 | 2256 |
| 1341914 | N/A | N/A | 19907 | 19922 | CTTAAGATACCCAGGT | $^mC_{ks}T_{ks}T_{ks}A_{ds}A_{ys}G_{ds}A_{ds}$ $T_{ds}A_{ds}{}^mC_{ds}{}^mC_{ds}{}^mC_{ds}A_{ds}$ $G_{ks}G_{ks}T_k$ | 50 | 241 |
| 1341919 | N/A | N/A | 20109 | 20124 | AAGACATTCTAGCCTG | $A_{ks}A_{ks}G_{ks}A_{ds}C_{ys}A_{ds}T_{ds}T_{ds}$ $^mC_{ds}T_{ds}A_{ds}G_{ds}{}^mC_{ds}{}^mC_{ks}T_{ks}$ $G_k$ | 54 | 2744 |
| 1341923 | N/A | N/A | 20119 | 20134 | TTACAGCATCAAGACA | $T_{ks}T_{ks}A_{ks}{}^mC_{ds}A_{ys}G_{ds}{}^mC_{ds}$ $A_{ds}T_{ds}{}^mC_{ds}A_{ds}A_{ds}G_{ds}A_{ks}$ $^mC_{ks}A_k$ | 46 | 2409 |
| 1341924 | 1078 | 1093 | 20893 | 20908 | CTAGUGCCAAACCAAT | $^mC_{ks}T_{ks}A_{ks}G_{ds}U_{ys}G_{ds}{}^mC_{ds}$ $^mC_{ds}A_{ds}A_{ds}A_{ds}{}^mC_{ds}{}^mC_{ds}$ $A_{ks}A_{ks}T_k$ | 45 | 2988 |
| 1341928 | N/A | N/A | 20194 | 20209 | TTGCAGTTATTAGAAG | $T_{ks}T_{ks}G_{ks}{}^mC_{ds}A_{ys}G_{ds}T_{ds}$ $T_{ds}A_{ds}T_{ds}T_{ds}A_{ds}G_{ds}A_{ks}$ $A_{ks}G_k$ | 17 | 2123 |
| 1341930 | N/A | N/A | 20383 | 20398 | GTAAUCACAAGTAAGG | $G_{ks}T_{ks}A_{ks}A_{ds}U_{ys}{}^mC_{ds}A_{ds}$ $^mC_{ds}A_{ds}A_{ds}G_{ds}T_{ds}A_{ds}A_{ks}$ $G_{ks}G_k$ | 20 | 2989 |
| 1341941 | N/A | N/A | 20489 | 20504 | CATAACTTCATAGTGG | $^mC_{ks}A_{ks}T_{ks}A_{ds}A_{ys}{}^mC_{ds}T_{ds}$ $T_{ds}{}^mC_{ds}A_{ds}T_{ds}A_{ds}G_{ds}T_{ks}$ $G_{ks}G_k$ | 38 | 866 |
| 1341942 | 1074 | 1089 | 20889 | 20904 | TGCCAAACCAATGTTT | $T_{ks}G_{ks}{}^mC_{ks}{}^mC_{ds}A_{ys}A_{ds}A_{ds}$ $^mC_{ds}{}^mC_{ds}A_{ds}A_{ds}T_{ds}G_{ds}T_{ks}$ $T_{ks}T_k$ | 35 | 2673 |
| 1341948 | N/A | N/A | 12503 | 12518 | TTGCAGAAATTCACCT | $T_{ks}T_{ks}G_{ks}{}^mC_{ds}A_{ys}G_{ds}A_{ds}$ $A_{ds}A_{ds}T_{ds}T_{ds}{}^mC_{ds}A_{ds}{}^mC_{ks}$ $^mC_{ks}T_k$ | 29 | 2528 |
| 1341953 | 1086 | 1101 | 20901 | 20916 | GACTGCTGCTAGTGCC | $G_{ks}A_{ks}{}^mC_{ks}T_{ds}G_{ys}{}^mC_{ds}T_{ds}$ $G_{ds}{}^mC_{ds}T_{ds}A_{ds}G_{ds}T_{ds}G_{ks}{}^m$ $C_{ks}{}^mC_k$ | 60 | 1899 |
| 1341957 | N/A | N/A | 20479 | 20494 | TAGTGGACTTCATTAG | $T_{ks}A_{ks}G_{ks}T_{ds}G_{ys}G_{ds}A_{ds}$ $^mC_{ds}T_{ds}T_{ds}{}^mC_{ds}A_{ds}T_{ds}T_{ks}$ $A_{ks}G_k$ | 34 | 2351 |

Example 5: Dose-Dependent Inhibition of Human HSD17B13 in HepaRG Cells by Modified Oligonucleotides Certain modified oligonucleotides described in the studies above exhibiting significant in vitro inhibition of HSD17B13 RNA were selected and tested at various doses in HepaRG cells.

The modified oligonucleotides were tested in a series of experiments using the same culture conditions. The results for each experiment are presented in separate tables shown below. Cultured HepaRG cells at a density of 30,000-35,000 cells per well were transfected using electroporation with modified oligonucleotides diluted to different concentrations as specified in the tables below. After a treatment period of approximately 24 hours, HSD17B13 RNA levels were measured as previously described using the Human HSD17B13 primer-probe set RTS43553. HSD17B13 RNA levels were normalized to total RNA content, as measured by human GAPDH. Results are presented in the tables below as percent inhibition of HSD17B13, relative to untreated control cells. Data indicated as "N.D." (no data) means that no data is available for that treatment with that compound.

The half maximal inhibitory concentration ($IC_{50}$) of each modified oligonucleotide was calculated using a linear regression on a log/linear plot of the data in excel and is also presented in the Tables below.

TABLE 53

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245094 | 0 | 5 | 75 | 68 | N.D. | 0.3 |
| 1245641 | 5 | 16 | 52 | 75 | 80 | 0.4 |
| 1245744 | 5 | 11 | 40 | 81 | 87 | 0.4 |
| 1245822 | 0 | 0 | 57 | 78 | 93 | 0.1 |
| 1245901 | 1 | 14 | 38 | 55 | 78 | 0.8 |
| 1245927 | 8 | 42 | 76 | 83 | 92 | 0.2 |
| 1245952 | 25 | 34 | 51 | 70 | 86 | 0.2 |
| 1245979 | 4 | 0 | 38 | 64 | 75 | 0.8 |
| 1246005 | 1 | 14 | 60 | 64 | 78 | 0.5 |
| 1246134 | 0 | 50 | 75 | 79 | N.D. | 0.2 |
| 1246135 | 10 | 10 | 42 | 68 | 88 | 0.5 |
| 1246161 | 18 | 20 | 63 | 75 | 86 | 0.3 |
| 1246550 | 14 | 28 | 58 | 76 | 88 | 0.3 |
| 1246706 | 60 | 69 | 68 | 76 | N.D. | 0.02 |

TABLE 54

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245096 | 3 | 17 | 70 | 85 | N.D. | 0.2 |
| 1245097 | 4 | 40 | 75 | 80 | 76 | 0.2 |
| 1245565 | 2 | 0 | 26 | 56 | 65 | 1.5 |
| 1245798 | 16 | 37 | 57 | 82 | 90 | 0.2 |
| 1245825 | 0 | 11 | 44 | 64 | 81 | 0.6 |
| 1245851 | 0 | 9 | 45 | 69 | 84 | 0.6 |
| 1245927 | 0 | 25 | 56 | 79 | 82 | 0.4 |
| 1245928 | 7 | 42 | 67 | 89 | 95 | 0.2 |
| 1245980 | 12 | 43 | 94 | 84 | N.D. | 0.1 |
| 1246059 | 1 | 15 | 44 | 68 | 81 | 0.5 |
| 1246084 | 4 | 18 | 69 | 89 | 93 | 0.2 |
| 1246110 | 10 | 41 | 71 | 90 | N.D. | 0.1 |
| 1246111 | 0 | 22 | 44 | 79 | 83 | 0.4 |
| 1246162 | 33 | 31 | 71 | 88 | 94 | 0.1 |
| 1246163 | 1 | 17 | 42 | 73 | 92 | 0.4 |

TABLE 55

Multi-dose assay of modified oligonucleotides in HepaRG cells

| ION No. | % inhibition HSD17B13 | | | | | IC$_{50}$ (μM) |
|---|---|---|---|---|---|---|
| | 19 nM | 78 nM | 313 nM | 1250 nM | 5000 nM | |
| 1245098 | 25 | 27 | 71 | 80 | 71 | 0.2 |
| 1245463 | 0 | 0 | 20 | 63 | 78 | 0.9 |
| 1245696 | 15 | 30 | 52 | 74 | 89 | 0.3 |
| 1245800 | 0 | 30 | 55 | 82 | 82 | 0.3 |
| 1245904 | 12 | 19 | 51 | 73 | 97 | 0.3 |
| 1245927 | 3 | 11 | 48 | 68 | 76 | 0.6 |
| 1245930 | 7 | 26 | 58 | 77 | 89 | 0.3 |
| 1245957 | 0 | 0 | 54 | 75 | 86 | 0.5 |
| 1245982 | 7 | 25 | 45 | 78 | 92 | 0.3 |
| 1245983 | 0 | 18 | 42 | 67 | 90 | 0.5 |
| 1246035 | 0 | 2 | 51 | 73 | 75 | 0.6 |
| 1246113 | 12 | 0 | 47 | 75 | 84 | 0.6 |
| 1247023 | 0 | 23 | 46 | 75 | 90 | 0.4 |
| 1247048 | 9 | 22 | 41 | 74 | 84 | 0.4 |
| 1247075 | 0 | 0 | 4 | 50 | 68 | 2.0 |

TABLE 56

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245075 | 20 | 50 | 62 | 75 | 86 | 0.1 |
| 1245829 | 18 | 33 | 58 | 83 | 94 | 0.2 |
| 1245855 | 16 | 21 | 59 | 78 | 89 | 0.3 |
| 1245927 | 0 | 21 | 54 | 69 | 76 | 0.5 |
| 1245932 | 22 | 24 | 56 | 90 | 94 | 0.2 |
| 1245933 | 23 | 24 | 63 | 76 | 89 | 0.2 |
| 1245958 | 12 | 31 | 43 | 87 | 84 | 0.3 |
| 1245959 | 1 | 10 | 46 | 65 | 90 | 0.5 |
| 1245984 | 9 | 37 | 62 | 76 | 93 | 0.2 |
| 1246036 | 15 | 33 | 65 | 80 | 95 | 0.2 |
| 1246063 | 16 | 29 | 53 | 84 | 85 | 0.2 |
| 1246115 | 0 | 38 | 66 | 88 | 92 | 0.2 |
| 1246140 | 20 | 2 | 54 | 75 | 86 | 0.5 |
| 1246192 | 0 | 17 | 52 | 72 | 89 | 0.5 |
| 1247024 | 16 | 45 | 82 | 89 | 97 | 0.1 |

TABLE 57

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245076 | 0 | 0 | 32 | 66 | 83 | 0.6 |
| 1245415 | 0 | 0 | 22 | 65 | 88 | 0.9 |
| 1245649 | 8 | 23 | 49 | 79 | 97 | 0.3 |
| 1245857 | 0 | 2 | 35 | 74 | 91 | 0.6 |
| 1245927 | 4 | 25 | 57 | 82 | 86 | 0.3 |
| 1245960 | 14 | 34 | 54 | 78 | 88 | 0.2 |
| 1245986 | 2 | 2 | 30 | 78 | 95 | 0.4 |
| 1245987 | 26 | 32 | 58 | 82 | 91 | 0.2 |
| 1246013 | 0 | 0 | 27 | 68 | 83 | 0.8 |
| 1246064 | 19 | 36 | 63 | 74 | 92 | 0.2 |
| 1246116 | 17 | 41 | 75 | 92 | 95 | 0.1 |
| 1246169 | 0 | 0 | 30 | 55 | 86 | 1.0 |
| 1246195 | 0 | 0 | 26 | 63 | 82 | 0.9 |
| 1246610 | 5 | 0 | 2 | 57 | 82 | 1.3 |
| 1247078 | 3 | 4 | 28 | 66 | 93 | 0.6 |

TABLE 58

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245105 | 0 | 0 | 24 | 61 | 88 | 0.8 |
| 1245651 | 3 | 22 | 49 | 78 | 89 | 0.3 |
| 1245676 | 0 | 0 | 34 | 67 | 91 | 0.7 |
| 1245806 | 28 | 27 | 51 | 69 | 91 | 0.2 |
| 1245807 | 1 | 9 | 47 | 80 | 90 | 0.4 |
| 1245858 | 16 | 39 | 66 | 86 | 96 | 0.2 |
| 1245927 | 0 | 22 | 46 | 79 | 89 | 0.4 |
| 1245988 | 8 | 26 | 40 | 65 | 85 | 0.5 |
| 1246066 | 26 | 41 | 63 | 86 | 94 | 0.1 |
| 1246067 | 0 | 0 | 40 | 51 | 85 | 0.9 |
| 1246093 | 0 | 0 | 24 | 64 | 86 | 0.7 |
| 1246144 | 5 | 30 | 43 | 78 | 86 | 0.3 |
| 1246145 | 0 | 3 | 40 | 72 | 85 | 0.6 |
| 1246248 | 28 | 32 | 62 | 86 | 92 | 0.1 |
| 1247029 | 0 | 0 | 11 | 36 | 73 | 1.9 |

TABLE 59

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245080 | 7 | 13 | 39 | 70 | 87 | 0.5 |
| 1245081 | 4 | 28 | 44 | 72 | 85 | 0.4 |
| 1245106 | 0 | 28 | 46 | 80 | 81 | 0.4 |
| 1245809 | 0 | 0 | 1 | 48 | 77 | 1.6 |
| 1245886 | 0 | 4 | 21 | 62 | 80 | 0.9 |
| 1245927 | 16 | 29 | 64 | 84 | 90 | 0.2 |
| 1245964 | 16 | 22 | 48 | 72 | 95 | 0.3 |
| 1245990 | 15 | 4 | 29 | 61 | 86 | 0.7 |
| 1245991 | 0 | 9 | 26 | 63 | 83 | 0.8 |
| 1246068 | 14 | 31 | 49 | 73 | 92 | 0.3 |
| 1246095 | 10 | 16 | 46 | 69 | 88 | 0.4 |
| 1246121 | 0 | 18 | 37 | 76 | 86 | 0.5 |
| 1246173 | 3 | 26 | 58 | 83 | 89 | 0.3 |
| 1246562 | 5 | 19 | 26 | 70 | 88 | 0.5 |

TABLE 60

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245212 | 3 | 1 | 43 | 63 | 88 | 0.6 |
| 1245680 | 0 | 0 | 22 | 64 | 82 | 0.9 |
| 1245681 | 0 | 17 | 58 | 80 | 94 | 0.3 |
| 1245888 | 17 | 22 | 41 | 72 | 87 | 0.4 |
| 1245927 | 0 | 16 | 52 | 78 | 93 | 0.4 |
| 1245967 | 0 | 9 | 41 | 62 | 89 | 0.6 |
| 1246019 | 17 | 26 | 62 | 92 | 91 | 0.2 |
| 1246070 | 7 | 31 | 46 | 74 | 94 | 0.3 |
| 1246123 | 0 | 16 | 37 | 58 | 83 | 0.7 |
| 1246226 | 12 | 30 | 56 | 86 | 89 | 0.2 |
| 1246227 | 0 | 6 | 0 | 55 | 78 | 1.4 |
| 1246824 | 0 | 0 | 17 | 40 | 81 | 1.5 |
| 1246902 | 0 | 17 | 40 | 74 | 86 | 0.5 |
| 1246903 | 35 | 35 | 60 | 68 | 84 | 0.2 |
| 1246929 | 0 | 18 | 40 | 65 | 87 | 0.6 |

TABLE 61

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245085 | 18 | 21 | 49 | 79 | 95 | 0.3 |
| 1245162 | 19 | 5 | 41 | 78 | 97 | 0.4 |
| 1245579 | 0 | 8 | 39 | 65 | 87 | 0.6 |
| 1245656 | 20 | 33 | 47 | 80 | 83 | 0.3 |
| 1245682 | 23 | 42 | 53 | 87 | 93 | 0.2 |
| 1245838 | 9 | 0 | 28 | 77 | 92 | 0.5 |
| 1245916 | 1 | 25 | 26 | 60 | 82 | 0.7 |
| 1245927 | 14 | 36 | 76 | 77 | 86 | 0.2 |
| 1245968 | 24 | 43 | 69 | 88 | 88 | 0.1 |
| 1245969 | 0 | 9 | 32 | 67 | 74 | 0.9 |
| 1246124 | 7 | 12 | 31 | 76 | 90 | 0.5 |
| 1246203 | 0 | 0 | 21 | 58 | 87 | 1.0 |
| 1246489 | 2 | 14 | 44 | 86 | 86 | 0.4 |
| 1246853 | 0 | 0 | 16 | 52 | 77 | 1.3 |
| 1247061 | 0 | 12 | 32 | 70 | 93 | 0.5 |

TABLE 62

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245580 | 3 | 9 | 49 | 58 | 89 | 0.5 |
| 1245607 | 0 | 16 | 33 | 77 | 87 | 0.5 |
| 1245684 | 35 | 51 | 77 | 92 | 96 | 0.1 |
| 1245685 | 13 | 25 | 59 | 80 | 93 | 0.2 |
| 1245736 | 0 | 0 | 45 | 81 | 95 | 0.6 |
| 1245737 | 13 | 23 | 53 | 83 | 94 | 0.3 |
| 1245919 | 0 | 0 | 0 | 72 | 90 | 1.0 |
| 1245927 | 0 | 9 | 37 | 84 | 77 | 0.4 |
| 1245996 | 29 | 53 | 74 | 91 | 97 | 0.1 |
| 1245997 | 16 | 31 | 54 | 79 | 90 | 0.2 |
| 1246022 | 49 | 54 | 80 | 93 | 94 | 0.0 |
| 1246023 | 0 | 40 | 89 | 86 | 95 | 0.2 |
| 1246048 | 12 | 0 | 73 | 73 | 97 | 0.3 |
| 1246074 | 7 | 43 | 73 | 84 | 94 | 0.2 |
| 1246075 | 0 | 0 | 41 | 70 | 88 | 0.7 |

TABLE 63

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245141 | 12 | 30 | 57 | 84 | 90 | 0.2 |
| 1245374 | 29 | 7 | 43 | 65 | 85 | 0.4 |
| 1245660 | 7 | 12 | 36 | 73 | 94 | 0.4 |
| 1245738 | 36 | 38 | 61 | 80 | 88 | 0.1 |
| 1245790 | 50 | 61 | 68 | 87 | 95 | <0.2 |
| 1245927 | 0 | 23 | 58 | 85 | 90 | 0.3 |
| 1245972 | 24 | 39 | 58 | 79 | 90 | 0.2 |
| 1245973 | 0 | 26 | 41 | 66 | 75 | 0.5 |
| 1245998 | 12 | 10 | 43 | 78 | 89 | 0.4 |
| 1245999 | 0 | 19 | 60 | 87 | 88 | 0.3 |
| 1246025 | 35 | 54 | 84 | 94 | 89 | 0.0 |
| 1246051 | 4 | 26 | 54 | 78 | 92 | 0.3 |
| 1246128 | 37 | 38 | 58 | 84 | 92 | 0.1 |
| 1246701 | 0 | 4 | 12 | 20 | 40 | 5.0 |
| 1246909 | 0 | 17 | 27 | 66 | 86 | 0.7 |

TABLE 64

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1245142 | 0 | 9 | 40 | 64 | 78 | 0.8 |
| 1245246 | 15 | 32 | 33 | 74 | 91 | 0.3 |
| 1245610 | 28 | 44 | 61 | 82 | 97 | 0.1 |
| 1245715 | 0 | 0 | 37 | 65 | 86 | 0.9 |
| 1245844 | 38 | 37 | 53 | 75 | 89 | 0.1 |
| 1245927 | 11 | 27 | 64 | 75 | 81 | 0.3 |
| 1245975 | 0 | 11 | 48 | 71 | 82 | 0.5 |
| 1246027 | 0 | 2 | 15 | 71 | 85 | 0.8 |
| 1246052 | 36 | 41 | 57 | 79 | 85 | 0.1 |
| 1246053 | 0 | 0 | 9 | 56 | 74 | 1.5 |
| 1246104 | 21 | 40 | 64 | 77 | 91 | 0.2 |
| 1246105 | 0 | 0 | 3 | 47 | 73 | 1.8 |
| 1246130 | 35 | 13 | 54 | 78 | 91 | 0.2 |
| 1246157 | 44 | 37 | 62 | 78 | 91 | 0.1 |
| 1246391 | 0 | 0 | 2 | 48 | 83 | 1.5 |

TABLE 65

Multi-dose assay of modified oligonucleotides in HepaRG cells

| ION No. | % inhibition HSD17B13 | | | | | IC$_{50}$ (μM) |
| --- | --- | --- | --- | --- | --- | --- |
| | 20 nM | 78 nM | 313 nM | 1250 nM | 5000 nM | |
| 1245092 | 9 | 20 | 39 | 68 | 89 | 0.4 |
| 1245639 | 0 | 0 | 21 | 65 | 85 | 0.8 |
| 1245716 | 20 | 27 | 40 | 69 | 86 | 0.4 |
| 1245927 | 0 | 0 | 25 | 74 | 64 | 1.2 |
| 1245976 | 9 | 29 | 57 | 77 | 86 | 0.3 |
| 1245977 | 0 | 21 | 44 | 76 | 94 | 0.4 |
| 1246002 | 38 | 51 | 64 | 79 | 91 | 0.1 |
| 1246028 | 0 | 0 | 19 | 56 | 80 | 1.2 |
| 1246029 | 0 | 18 | 50 | 73 | 86 | 0.4 |
| 1246081 | 5 | 19 | 48 | 75 | 88 | 0.4 |
| 1246185 | 13 | 15 | 43 | 62 | 79 | 0.6 |
| 1246314 | 3 | 8 | 36 | 72 | 92 | 0.5 |
| 1246340 | 28 | 32 | 37 | 58 | 85 | 0.4 |
| 1246705 | 1 | 14 | 20 | 42 | 70 | 1.8 |
| 1246861 | 0 | 0 | 7 | 25 | 63 | 5.0 |

TABLE 66

Multi-dose assay of modified oligonucleotides in HepaRG cells

| ION No. | % inhibition HSD17B13 | | | | | IC$_{50}$ (μM) |
| --- | --- | --- | --- | --- | --- | --- |
| | 20 nM | 78 nM | 313 nM | 1250 nM | 5000 nM | |
| 1246023 | 9 | 21 | 57 | 83 | 87 | 0.3 |
| 1340071 | 0 | 0 | 0 | 56 | 88 | 1.3 |
| 1340085 | 0 | 0 | 27 | 68 | 91 | 0.8 |
| 1340154 | 0 | 20 | 48 | 80 | 90 | 0.4 |
| 1340360 | 0 | 0 | 0 | 51 | 42 | 3.8 |
| 1340385 | 4 | 35 | 69 | 82 | 72 | 0.3 |
| 1340448 | 0 | 0 | 27 | 78 | 74 | 0.9 |
| 1340543 | 5 | 15 | 62 | 78 | 86 | 0.3 |
| 1340546 | 0 | 12 | 40 | 65 | 56 | 1.2 |
| 1340549 | 0 | 4 | 50 | 78 | 92 | 0.4 |
| 1340601 | 0 | 0 | 31 | 54 | 81 | 1.1 |
| 1340684 | 0 | 0 | 31 | 58 | 84 | 0.9 |
| 1340704 | 0 | 8 | 25 | 69 | 83 | 0.8 |
| 1340762 | 0 | 13 | 41 | 71 | 79 | 0.7 |
| 1340878 | 1 | 1 | 30 | 79 | 85 | 0.6 |

TABLE 67

Multi-dose assay of modified oligonucleotides in HepaRG cells

| ION No. | % inhibition HSD17B13 | | | | | IC$_{50}$ (μM) |
| --- | --- | --- | --- | --- | --- | --- |
| | 20 nM | 78 nM | 313 nM | 1250 nM | 5000 nM | |
| 1246023 | 0 | 20 | 55 | 82 | 88 | 0.4 |
| 1340206 | 0 | 22 | 55 | 71 | 90 | 0.4 |
| 1340208 | 12 | 12 | 51 | 69 | 92 | 0.4 |
| 1340226 | 0 | 0 | 43 | 73 | 96 | 0.6 |
| 1340260 | 0 | 0 | 33 | 56 | 78 | 1.0 |
| 1340268 | 0 | 0 | 35 | 55 | 90 | 0.9 |
| 1340334 | 0 | 5 | 30 | 67 | 86 | 0.8 |
| 1340397 | 0 | 0 | 49 | 73 | 88 | 0.7 |
| 1340555 | 1 | 13 | 41 | 63 | 76 | 0.7 |
| 1340585 | 0 | 13 | 47 | 77 | 74 | 0.6 |
| 1340603 | 18 | 16 | 47 | 69 | 85 | 0.4 |
| 1340647 | 14 | 35 | 76 | 83 | 94 | 0.2 |
| 1340789 | 10 | 14 | 32 | 73 | 83 | 0.5 |
| 1340834 | 14 | 18 | 48 | 74 | 79 | 0.4 |
| 1340895 | 0 | 19 | 32 | 65 | 87 | 0.6 |

TABLE 68

Multi-dose assay of modified oligonucleotides in HepaRG cells

| ION No. | % inhibition HSD17B13 | | | | | IC$_{50}$ (μM) |
| --- | --- | --- | --- | --- | --- | --- |
| | 20 nM | 78 nM | 313 nM | 1250 nM | 5000 nM | |
| 1246023 | 0 | 25 | 47 | 76 | 85 | 0.4 |
| 1340168 | 6 | 0 | 32 | 80 | 90 | 0.6 |
| 1340401 | 4 | 11 | 50 | 78 | 79 | 0.4 |
| 1340449 | 26 | 8 | 59 | 81 | 93 | 0.3 |
| 1340548 | 0 | 17 | 51 | 78 | 92 | 0.4 |
| 1340626 | 0 | 5 | 45 | 80 | 90 | 0.5 |
| 1340646 | 6 | 31 | 57 | 67 | 58 | 0.6 |
| 1340653 | 2 | 0 | 38 | 69 | 77 | 0.8 |
| 1340780 | 6 | 23 | 36 | 73 | 83 | 0.5 |
| 1340820 | 20 | 35 | 55 | 84 | 88 | 0.2 |
| 1340821 | 0 | 0 | 21 | 40 | 60 | 2.7 |
| 1340847 | 9 | 20 | 45 | 60 | 88 | 0.5 |
| 1340857 | 0 | 0 | 11 | 46 | 66 | 2.3 |
| 1340859 | 14 | 32 | 47 | 71 | 84 | 0.3 |
| 1340908 | 16 | 33 | 60 | 84 | 92 | 0.2 |

TABLE 69

Multi-dose assay of modified oligonucleotides in HepaRG cells

| ION No. | % inhibition HSD17B13 | | | | | IC$_{50}$ (μM) |
| --- | --- | --- | --- | --- | --- | --- |
| | 20 nM | 78 nM | 313 nM | 1250 nM | 5000 nM | |
| 1246023 | 0 | 16 | 42 | 80 | 87 | 0.5 |
| 1340153 | 0 | 18 | 38 | 75 | 82 | 0.5 |
| 1340227 | 0 | 21 | 57 | 70 | 90 | 0.4 |
| 1340435 | 14 | 27 | 57 | 78 | 90 | 0.3 |
| 1340441 | 6 | 14 | 32 | 70 | 74 | 0.7 |
| 1340493 | 13 | 23 | 54 | 70 | 88 | 0.3 |
| 1340510 | 11 | 13 | 27 | 66 | 87 | 0.6 |
| 1340511 | 0 | 0 | 7 | 52 | 74 | 1.6 |
| 1340572 | 19 | 23 | 53 | 75 | 89 | 0.3 |
| 1340630 | 20 | 25 | 42 | 75 | 87 | 0.3 |
| 1340670 | 16 | 24 | 51 | 74 | 93 | 0.3 |
| 1340782 | 0 | 26 | 54 | 77 | 92 | 0.3 |
| 1340840 | 0 | 3 | 23 | 43 | 67 | 1.9 |
| 1340848 | 0 | 0 | 30 | 71 | 91 | 0.7 |
| 1340861 | 22 | 34 | 47 | 74 | 90 | 0.2 |

TABLE 70

Multi-dose assay of modified oligonucleotides in HepaRG cells

| ION No. | % inhibition HSD17B13 | | | | | IC$_{50}$ (μM) |
| --- | --- | --- | --- | --- | --- | --- |
| | 20 nM | 78 nM | 313 nM | 1250 nM | 5000 nM | |
| 1246023 | 3 | 22 | 55 | 79 | 84 | 0.3 |
| 1340159 | 10 | 13 | 49 | 83 | 80 | 0.4 |
| 1340481 | 0 | 0 | 34 | 64 | 82 | 0.8 |
| 1340502 | 0 | 4 | 37 | 71 | 87 | 0.6 |
| 1340564 | 5 | 10 | 34 | 72 | 85 | 0.5 |
| 1340635 | 7 | 21 | 40 | 79 | 82 | 0.4 |
| 1340649 | 0 | 0 | 42 | 69 | 89 | 0.6 |
| 1340672 | 0 | 20 | 47 | 72 | 76 | 0.6 |
| 1340743 | 12 | 18 | 46 | 80 | 90 | 0.3 |
| 1340779 | 5 | 7 | 39 | 68 | 40 | 0.6 |
| 1340793 | 3 | 24 | 66 | 86 | 91 | 0.2 |
| 1340796 | 0 | 19 | 61 | 88 | 84 | 0.3 |
| 1340799 | 16 | 34 | 72 | 86 | 89 | 0.2 |
| 1340827 | 16 | 31 | 48 | 72 | 81 | 0.3 |
| 1340881 | 10 | 28 | 52 | 59 | 79 | 0.4 |

TABLE 71

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1246023 | 0 | 20 | 42 | 58 | 79 | 0.7 |
| 1341183 | 11 | 18 | 27 | 53 | 57 | 2.0 |
| 1341190 | 0 | 3 | 29 | 53 | 48 | 2.4 |
| 1341193 | 11 | 27 | 53 | 63 | 68 | 0.5 |
| 1341195 | 15 | 13 | 12 | 61 | 71 | 1.2 |
| 1341239 | 16 | 0 | 27 | 62 | 83 | 0.7 |
| 1341262 | 0 | 4 | 36 | 52 | 78 | 0.9 |
| 1341273 | 6 | 18 | 38 | 63 | 81 | 0.6 |
| 1341303 | 29 | 21 | 44 | 61 | 90 | 0.3 |
| 1341313 | 9 | 33 | 58 | 67 | 85 | 0.3 |
| 1341315 | 8 | 28 | 52 | 79 | 82 | 0.3 |
| 1341342 | 24 | 25 | 37 | 51 | 81 | 0.6 |
| 1341348 | 15 | 25 | 43 | 71 | 70 | 0.5 |
| 1341391 | 0 | 2 | 35 | 49 | 70 | 1.3 |
| 1341547 | 13 | 2 | 40 | 61 | 83 | 0.6 |

TABLE 72

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1246023 | 19 | 1 | 38 | 77 | 89 | 0.4 |
| 1341026 | 10 | 20 | 43 | 73 | 83 | 0.4 |
| 1341032 | 0 | 13 | 14 | 74 | 92 | 0.6 |
| 1341035 | 5 | 0 | 36 | 62 | 74 | 1.0 |
| 1341036 | 23 | 28 | 53 | 78 | 93 | 0.2 |
| 1341038 | 17 | 25 | 57 | 76 | 85 | 0.3 |
| 1341052 | 6 | 13 | 52 | 69 | 79 | 0.5 |
| 1341062 | 0 | 23 | 47 | 66 | 79 | 0.5 |
| 1341095 | 0 | 17 | 51 | 61 | 81 | 0.6 |
| 1341108 | 28 | 34 | 58 | 81 | 83 | 0.2 |
| 1341146 | 6 | 0 | 39 | 66 | 70 | 0.9 |
| 1341206 | 28 | 25 | 45 | 81 | 87 | 0.2 |
| 1341260 | 23 | 24 | 37 | 66 | 78 | 0.5 |
| 1341283 | 8 | 23 | 40 | 67 | 90 | 0.4 |
| 1341308 | 18 | 29 | 54 | 71 | 86 | 0.3 |

TABLE 73

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1246023 | 0 | 0 | 47 | 66 | 89 | 0.6 |
| 1340983 | 0 | 0 | 26 | 55 | 45 | 3.1 |
| 1340995 | 1 | 17 | 37 | 66 | 62 | 0.9 |
| 1341011 | 0 | 0 | 34 | 50 | 81 | 1.0 |
| 1341043 | 0 | 3 | 40 | 50 | 44 | 2.2 |
| 1341050 | 0 | 7 | 39 | 55 | 76 | 0.9 |
| 1341057 | 6 | 9 | 39 | 57 | 78 | 0.8 |
| 1341068 | 0 | 0 | 11 | 46 | 79 | 1.5 |
| 1341075 | 0 | 0 | 0 | 39 | 55 | 3.1 |
| 1341118 | 0 | 8 | 13 | 31 | 74 | 2.2 |
| 1341145 | 0 | 17 | 37 | 69 | 83 | 0.6 |
| 1341154 | 0 | 0 | 47 | 43 | 79 | 1.0 |
| 1341244 | 10 | 0 | 21 | 55 | 68 | 1.5 |
| 1341335 | 0 | 0 | 25 | 51 | 55 | 2.4 |
| 1341510 | 4 | 17 | 34 | 57 | 66 | 1.0 |

TABLE 74

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1246023 | 1 | 20 | 59 | 67 | 88 | 0.4 |
| 1340992 | 0 | 0 | 0 | 51 | 76 | 1.8 |
| 1341004 | 0 | 12 | 31 | 55 | 77 | 0.9 |
| 1341022 | 15 | 18 | 25 | 65 | 84 | 0.6 |
| 1341048 | 1 | 15 | 43 | 74 | 85 | 0.5 |
| 1341077 | 8 | 16 | 38 | 54 | 71 | 0.9 |
| 1341104 | 0 | 23 | 38 | 64 | 79 | 0.6 |
| 1341140 | 12 | 17 | 41 | 64 | 82 | 0.5 |
| 1341151 | 13 | 31 | 52 | 71 | 80 | 0.3 |
| 1341271 | 8 | 0 | 43 | 65 | 80 | 0.7 |
| 1341318 | 23 | 17 | 49 | 61 | 55 | 1.0 |
| 1341436 | 0 | 23 | 46 | 64 | 77 | 0.6 |
| 1341437 | 3 | 0 | 16 | 60 | 88 | 0.9 |
| 1341654 | 0 | 24 | 53 | 66 | 69 | 0.6 |
| 1341668 | 7 | 25 | 42 | 56 | 82 | 0.6 |

TABLE 75

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1246023 | 2 | 24 | 40 | 70 | 92 | 0.4 |
| 1341651 | 19 | 35 | 41 | 67 | 85 | 0.3 |
| 1341655 | 0 | 0 | 13 | 70 | 89 | 0.9 |
| 1341671 | 13 | 27 | 35 | 66 | 91 | 0.4 |
| 1341675 | 9 | 22 | 46 | 77 | 76 | 0.4 |
| 1341686 | 2 | 2 | 31 | 61 | 78 | 0.9 |
| 1341703 | 16 | 14 | 33 | 52 | 58 | 1.8 |
| 1341735 | 12 | 32 | 54 | 71 | 84 | 0.3 |
| 1341742 | 13 | 26 | 39 | 66 | 84 | 0.4 |
| 1341797 | 0 | 0 | 34 | 65 | 91 | 0.6 |
| 1341815 | 0 | 21 | 20 | 65 | 75 | 0.9 |
| 1341839 | 25 | 16 | 39 | 60 | 87 | 0.5 |
| 1341899 | 14 | 28 | 42 | 66 | 77 | 0.5 |
| 1341911 | 7 | 29 | 46 | 67 | 90 | 0.4 |
| 1341913 | 0 | 2 | 0 | 48 | 59 | 3.2 |

TABLE 76

Multi-dose assay of modified oligonucleotides in HepaRG cells

| ION No. | % inhibition HSD17B13 | | | | | IC$_{50}$ (μM) |
|---|---|---|---|---|---|---|
| | 20 nM | 78 nM | 313 nM | 1250 nM | 5000 nM | |
| 1246023 | 0 | 7 | 18 | 81 | 92 | 0.6 |
| 1341531 | 18 | 21 | 38 | 62 | 76 | 0.6 |
| 1341561 | 26 | 22 | 39 | 75 | 70 | 0.4 |
| 1341644 | 0 | 11 | 60 | 82 | 90 | 0.4 |
| 1341645 | 0 | 20 | 0 | 39 | 79 | 1.8 |
| 1341646 | 3 | 0 | 8 | 57 | 76 | 1.3 |
| 1341968 | 0 | 0 | 10 | 72 | 90 | 0.8 |
| 1341980 | 8 | 9 | 26 | 54 | 78 | 1.0 |

Example 6: Design of Human HSD17B13 Modified Oligonucleotides

Certain modified oligonucleotides described above were further modified by conjugating at the 5'-end with a LICA-1 moiety. The resulting compounds and their unconjugated counterparts are listed in the table below. The compounds have identical sequence and oligonucleotide chemistry as the "parent compounds" described above.

TABLE 77

Design of 5'-LICA-1-conjugated modified oligonucleotides targeting human HSD17B13

| GalNac Conjugated Compound No. | Parent Compound No. | Sequence (5' to 3') | SEQ ID NO |
|---|---|---|---|
| 1310535 | 1246163 | CAACTATGTAATAGGC | 286 |
| 1371966 | 1245806 | AAAATAGAGTCGGTCA | 817 |
| 1371968 | 1246068 | AGCATAAGTTACCAGA | 983 |
| 1371969 | 1246115 | AAATTATACTTTTCCG | 596 |
| 1371971 | 1246063 | GTTTTATAACTGAGCT | 594 |
| 1371973 | 1246019 | GAATTTTGAGGTTGG | 1215 |
| 1371974 | 1245987 | TCTCAAGGAGTACTTC | 747 |
| 1371976 | 1245952 | GTCATAAAAATCGCTG | 43 |
| 1371978 | 1245930 | AAGATAAGTAGATGGT | 355 |
| 1371979 | 1245972 | GCACTAAAGGTTTCTG | 1602 |
| 1371981 | 1245980 | ATACTAATGTCCAAGG | 201 |
| 1373086 | 1245649 | CTACTTGAACAGTCTT | 734 |
| 1373087 | 1246903 | AGTTAGTATAGTTATC | 1249 |
| 1373089 | 1246134 | CTCATTTATGTACCAA | 51 |
| 1373090 | 1246162 | ACTATGTAATAGGCAG | 208 |
| 1373097 | 1245984 | ACAATTTTTCCAATCC | 513 |
| 1373098 | 1246022 | AGTGAATCATTCAGTA | 1449 |
| 1373099 | 1245996 | CATTCGAATTTCTTCA | 1448 |
| 1373101 | 1245790 | GTATCTTATAAGACTA | 1595 |
| 1394140 | 1341675 | CTACUTGAACAGTCTT | 2868 |
| 1394141 | 1340820 | GTAGATGGTAAGTCAA | 2567 |
| 1394142 | 1341283 | TGATATTCTGTGGCAT | 1124 |
| 1394143 | 1341313 | TATGTAATAGCCAGTA | 508 |
| 1394144 | 1341742 | GTATCTTATAAGACTA | 1595 |
| 1394145 | 1341038 | TTCTTATGTAATAGCC | 819 |
| 1394146 | 1341735 | CACCGTTTTGGGCTAA | 1516 |
| 1394147 | 1341032 | TTATGTAATAGCCAGT | 586 |
| 1394148 | 1341108 | GCATCTTAAGATACCC | 553 |
| 1394149 | 1340435 | TAGAACTGTGTTGCTT | 2535 |
| 1394150 | 1340908 | TAGAGTGAATCATTCA | 2420 |
| 1394151 | 1340208 | GAGTAGTGTAAGCTGA | 2204 |
| 1394152 | 1340782 | GAGATTTGAAGGTTAG | 2561 |
| 1371970 | 1246157 | GCAGTAAAGTGCTAAG | 1843 |
| 1371972 | 1246025 | AGCCTTAGAGTGAATC | 1682 |

TABLE 77-continued

Design of 5'-LICA-1-conjugated modified oligonucleotides targeting human HSD17B13

| GalNac Conjugated Compound No. | Parent Compound No. | Sequence (5' to 3') | SEQ ID NO |
|---|---|---|---|
| 1373094 | 1246036 | TGAAAACTCAGCCAGC | 515 |
| 1373096 | 1245968 | GTAATTTTCAGATCCC | 1291 |
| 1373100 | 1245682 | GTTGATATTCTGTGGC | 1280 |

Example 7: Dose-Dependent Ex-Vivo Inhibition of Human HSD17B13 in Transgenic Mouse Hepatocytes The conjugated modified oligonucleotides described above were tested for inhibition of HSD17B13 RNA at various doses in primary mouse hepatocytes extracted from transgenic mice.

A transgenic mouse model was developed in-house using a Fosmid containing the human HSD17B13 gene (NCBI Clone DB ID: ABC8-43206400A 10). The clone was digested at Not1 restriction sites (2 different sites) to produce a fragment containing 19,118 bp of the human HSD17B13 gene, including 12,175 bp upstream and 7,553 bp downstream regions. That gene fragment was introduced into fertilized eggs from C57IBL/6NTac strain mice by pronuclear injection to produce huHSD 17469 and 17470 founder lines. Transgenic mice derived from Founder Line 17469 was used in the experiments described herein. Human HSD17B13 RNA expression is found in the liver in this model. Mice were sacrificed and hepatocytes were collected for use in experiments testing conjugated modified oligonucleotides.

The conjugated modified oligonucleotides were tested in a series of experiments using the same culture conditions. The results for each experiment are presented in separate tables shown below. Primary mouse transgenic hepatocytes described above were plated at a density of 20,000 cells per well and were treated by free uptake with conjugated modified oligonucleotides diluted to different concentrations as specified in the tables below. After an overnight incubation, HSD17B13 RNA levels were measured as previously described herein using the Human HSD17B13 primer-probe set RTS43553. HSD17B13 RNA levels were normalized to total GAPDH content. Results are presented in the tables below as percent inhibition of HSD17B13, relative to untreated control cells. The half maximal inhibitory concentration ($IC_{50}$) of each modified oligonucleotide was calculated using a linear regression on a log/linear plot of the data in excel and is also presented in the Tables below.

TABLE 78

Multi-dose assay of modified oligonucleotides in primary mouse hepatocytes

| | % Inhibition | | | | | | |
|---|---|---|---|---|---|---|---|
| ION No. | 1.95 nM | 7.81 nM | 31.25 nM | 125 nM | 500 nM | 2000 nM | $IC_{50}$ (nM) |
| 1310535 | 38 | 53 | 80 | 87 | 85 | 90 | 3.2 |
| 1371966 | 41 | 52 | 87 | 88 | 91 | 89 | 4.1 |

TABLE 78-continued

Multi-dose assay of modified oligonucleotides in primary mouse hepatocytes

| ION No. | % Inhibition | | | | | | $IC_{50}$ (nM) |
|---|---|---|---|---|---|---|---|
| | 1.95 nM | 7.81 nM | 31.25 nM | 125 nM | 500 nM | 2000 nM | |
| 1371968 | 39 | 56 | 84 | 94 | 91 | 90 | 4.1 |
| 1371969 | 23 | 60 | 81 | 88 | 88 | 92 | 5.2 |
| 1371971 | 6 | 45 | 54 | 70 | 85 | 76 | 34.1 |
| 1371973 | 38 | 61 | 84 | 93 | 94 | 96 | 2.2 |
| 1371974 | 4 | 31 | 65 | 74 | 74 | 82 | 38.6 |
| 1371976 | 16 | 62 | 79 | 87 | 90 | 93 | 7.3 |
| 1371978 | 0 | 39 | 84 | 92 | 89 | 88 | 18.4 |
| 1371979 | 10 | 38 | 70 | 82 | 85 | 87 | 21.0 |
| 1371981 | 33 | 68 | 86 | 94 | 93 | 95 | 1.9 |

TABLE 79

Multi-dose assay of modified oligonucleotides in primary mouse hepatocytes

| ION No. | % Inhibition | | | | | | $IC_{50}$ (nM) |
|---|---|---|---|---|---|---|---|
| | 1.95 nM | 7.81 nM | 31.25 nM | 125 nM | 500 nM | 2000 nM | |
| 1373086 | 24 | 49 | 78 | 83 | 86 | 84 | 8.9 |
| 1373087 | 23 | 20 | 67 | 70 | 64 | 65 | 22.6 |
| 1373089 | 36 | 62 | 84 | 92 | 91 | 92 | 4.0 |
| 1373090 | 43 | 49 | 69 | 81 | 80 | 82 | 5.4 |
| 1373097 | 41 | 64 | 84 | 89 | 92 | 91 | 1.3 |
| 1373098 | 43 | 69 | 80 | 87 | 89 | 89 | 2.3 |
| 1373099 | 19 | 37 | 68 | 84 | 83 | 86 | 13.8 |
| 1373101 | 9 | 41 | 66 | 83 | 85 | 92 | 20.5 |
| 1394140 | 5 | 42 | 80 | 78 | 85 | 88 | 19.6 |
| 1394142 | 5 | 49 | 73 | 87 | 89 | 91 | 16.4 |
| 1371966 | 4 | 55 | 77 | 88 | 88 | 87 | 11.5 |

TABLE 80

Multi-dose assay of modified oligonucleotides in primary mouse hepatocytes

| ION No. | % Inhibition | | | | | | $IC_{50}$ (nM) |
|---|---|---|---|---|---|---|---|
| | 1.95 nM | 7.81 nM | 31.25 nM | 125 nM | 500 nM | 2000 nM | |
| 1394143 | 19 | 45 | 80 | 83 | 89 | 89 | 10.6 |
| 1394144 | 16 | 21 | 54 | 70 | 75 | 80 | 48.1 |
| 1394145 | 37 | 44 | 83 | 91 | 88 | 88 | 6.2 |
| 1394146 | 3 | 30 | 67 | 74 | 82 | 77 | 38.2 |
| 1394147 | 30 | 71 | 85 | 94 | 94 | 93 | 4.0 |
| 1394148 | 41 | 80 | 88 | 90 | 87 | 91 | 1.7 |
| 1394149 | 1 | 26 | 56 | 72 | 78 | 82 | 50.9 |
| 1394150 | 14 | 45 | 80 | 84 | 88 | 85 | 12.8 |
| 1394151 | 0 | 37 | 63 | 81 | 83 | 85 | 42.5 |
| 1394152 | 8 | 35 | 63 | 82 | 81 | 87 | 28.1 |
| 1371966 | 0 | 61 | 72 | 82 | 89 | 88 | 16.7 |

Example 8: Tolerability of Modified Oligonucleotides Complementary to Human HSD17B13 in CD-1 Mice CD-1 mice are a multipurpose mouse model frequently utilized for safety and efficacy testing. In this study, CD-1 mice were treated with conjugated modified oligonucleotides selected from studies described above and evaluated for changes in the levels of various plasma chemistry markers.

Treatment

Groups of 6- to 8-week-old male CD-1 mice were injected subcutaneously once a week for six weeks (for a total of 7 treatments) with 25 mg/kg of conjugated modified oligonucleotides. One group of male CD-1 mice was injected with PBS. Mice were euthanized 48 hours following the final administration.

Study 1

Plasma Chemistry Markers

To evaluate the effect of conjugated modified oligonucleotides on liver function, plasma levels of blood urea nitrogen (BUN), albumin, alanine aminotransferase (ALT), aspartate aminotransferase (AST), and creatinine (CREA) were measured using an automated clinical chemistry analyzer (Hitachi Olympus AU400c, Melville, NY). The results are presented in the table below.

TABLE 81

Plasma chemistry markers in male CD-1 mice

| ION NO. | Albumin (g/dL) | ALT (IU/L) | AST (IU/L) | CREA (mg/dL) | BUN (mg/dL) |
|---|---|---|---|---|---|
| PBS | 2.5 | 25 | 52 | 0.2 | 23 |
| 1310535 | 2.6 | 32 | 44 | 0.2 | 24 |
| 1371966 | 2.7 | 31 | 40 | 0.2 | 23 |
| 1371968 | 2.7 | 26 | 42 | 0.2 | 23 |
| 1371969 | 2.6 | 28 | 59 | 0.2 | 24 |
| 1371970 | 2.6 | 277 | 225 | 0.2 | 24 |
| 1371971 | 2.8 | 41 | 74 | 0.2 | 24 |
| 1371972 | 2.4 | 810 | 568 | 0.2 | 24 |
| 1371973 | 2.3 | 50 | 78 | 0.2 | 22 |
| 1371974 | 2.7 | 60 | 61 | 0.2 | 25 |
| 1371976 | 2.7 | 32 | 61 | 0.2 | 22 |
| 1371978 | 2.7 | 51 | 59 | 0.2 | 21 |
| 1371979 | 2.7 | 32 | 70 | 0.2 | 23 |

Body and Organ Weights

Body weights of CD-1 mice were measured at days 1 and 44, and the average body weight for each group is presented in the table below. Liver, kidney and spleen weights were measured at the end of the study and are presented in the table below.

TABLE 82

Body and organ weights (in grams)

| ION No. | Body Weight (g) | | Liver (g) | Kidney (g) | Spleen (g) |
|---|---|---|---|---|---|
| | Day 1 | Day 44 | | | |
| PBS | 34 | 42 | 2.4 | 0.5 | 0.1 |
| 1310535 | 33 | 42 | 2.4 | 0.6 | 0.1 |
| 1371966 | 32 | 39 | 2.2 | 0.6 | 0.1 |
| 1371968 | 30 | 38 | 2.1 | 0.5 | 0.1 |
| 1371969 | 33 | 43 | 2.4 | 0.5 | 0.1 |
| 1371970 | 29 | 36 | 2.1 | 0.5 | 0.1 |
| 1371971 | 33 | 41 | 2.5 | 0.6 | 0.2 |
| 1371972 | 33 | 40 | 3.1 | 0.7 | 0.2 |
| 1371973 | 31 | 38 | 1.7 | 0.5 | 0.1 |
| 1371974 | 34 | 40 | 2.4 | 0.6 | 0.1 |
| 1371976 | 32 | 40 | 2.4 | 0.6 | 0.1 |
| 1371978 | 32 | 38 | 2.4 | 0.5 | 0.1 |
| 1371979 | 33 | 38 | 2.3 | 0.6 | 0.1 |

Hematology Assays

Blood obtained from mouse groups at week 6 and was sent to IDEXX BioResearch for measurement of hematocrit (MIT), and platelet counts (PLT). The results are presented in the table below.

TABLE 83

Blood cell counts in male CD-1 mice

| ION NO. | HCT (%) | PLT ($10^9$/L) |
|---|---|---|
| PBS | 46 | 1155 |
| 1310535 | 50 | 1389 |
| 1371966 | 46 | 1415 |
| 1371968 | 47 | 1372 |
| 1371969 | 45 | 1059 |
| 1371970 | 48 | 1395 |
| 1371971 | 46 | 1244 |
| 1371972 | 44 | 1360 |
| 1371973 | 47 | 968 |
| 1371974 | 45 | 1362 |
| 1371976 | 49 | 1199 |
| 1371978 | 47 | 1417 |
| 1371979 | 48 | 1190 |

Study 2
Plasma Chemistry Markers

To evaluate the effect of modified oligonucleotides on liver function, plasma levels of blood urea nitrogen (BUN), albumin, alanine aminotransferase (ALT), aspartate aminotransferase (AST), and creatinine (CREA) were measured using an automated clinical chemistry analyzer (Hitachi Olympus AU400c, Melville, NY). The results are presented in the table below.

TABLE 84

Plasma chemistry markers in male CD-1 mice

| ION NO. | Albumin (g/dL) | ALT (IU/L) | AST (IU/L) | CREA (mg/dL) | BUN (mg/dL) |
|---|---|---|---|---|---|
| PBS | 2.8 | 36 | 57 | 0.11 | 19 |
| 1371981 | 2.7 | 26 | 39 | 0.14 | 24 |
| 1373086 | 2.6 | 39 | 59 | 0.12 | 24 |
| 1373087 | 2.6 | 31 | 54 | 0.13 | 23 |
| 1373089 | 2.5 | 107 | 88 | 0.12 | 24 |
| 1373090 | 2.5 | 27 | 45 | 0.11 | 25 |
| 1373094 | 2.8 | 687 | 532 | 0.15 | 23 |
| 1373096 | 2.7 | 57 | 87 | 0.13 | 23 |
| 1373097 | 2.4 | 67 | 71 | 0.13 | 23 |
| 1373098 | 2.5 | 67 | 73 | 0.12 | 24 |
| 1373099 | 2.7 | 43 | 75 | 0.12 | 22 |
| 1373100 | 2.7 | 373 | 365 | 0.12 | 25 |
| 1373101 | 2.5 | 153 | 179 | 0.14 | 23 |

Body and Organ Weights

Body weights of CD-1 mice were measured at days 1 and 42, and the average body weight for each group is presented in the table below. Liver, kidney and spleen weights were measured at the end of the study and are presented in the table below.

TABLE 85

Body and organ weights (in grams)

| ION No. | Body Weight (g) Day 1 | Body Weight (g) Day 42 | Liver (g) | Kidney (g) | Spleen (g) |
|---|---|---|---|---|---|
| PBS | 27 | 38 | 1.9 | 0.6 | 0.1 |
| 1371981 | 27 | 39 | 2.5 | 0.6 | 0.1 |
| 1373086 | 27 | 38 | 2.1 | 0.5 | 0.1 |
| 1373087 | 27 | 40 | 2.4 | 0.6 | 0.1 |
| 1373089 | 26 | 39 | 2.8 | 0.5 | 0.1 |
| 1373090 | 27 | 38 | 2.4 | 0.5 | 0.2 |
| 1373094 | 28 | 41 | 2.9 | 0.6 | 0.2 |
| 1373096 | 27 | 42 | 2.5 | 0.6 | 0.2 |
| 1373097 | 27 | 42 | 2.52 | 0.49 | 0.17 |
| 1373098 | 27 | 39 | 2.48 | 0.51 | 0.13 |
| 1373099 | 27 | 39 | 2.44 | 0.61 | 0.14 |
| 1373100 | 26 | 37 | 2.11 | 0.52 | 0.16 |
| 1373101 | 29 | 45 | 2.68 | 0.63 | 0.20 |

Hematology Assays

Blood obtained from mouse groups at week 6 and was sent to IDEXX BioResearch for measurement of hematocrit (HCT), platelet counts (PLT), neutrophil counts (NEU), reticulocyte counts (RET) and lymphocyte counts (LYM). The results are presented in the table below.

TABLE 86

Blood cell counts in male CD-1 mice

| ION NO. | HCT (%) | PLT ($10^3$/μL) | NEU (%) | RET (%) | LYM (%) |
|---|---|---|---|---|---|
| PBS | 45 | 1150 | 19 | 3 | 77 |
| 1371981 | 46 | 1398 | 18 | 3 | 76 |
| 1373086 | 44 | 1415 | 17 | 3 | 74 |
| 1373087 | 42 | 1343 | 21 | 3 | 73 |
| 1373089 | 43 | 1216 | 21 | 3 | 72 |
| 1373090 | 42 | 1332 | 21 | 3 | 52 |
| 1373094 | 44 | 1307 | 24 | 3 | 68 |
| 1373096 | 47 | 1161 | 19 | 3 | 69 |
| 1373097 | 42 | 1394 | 25 | 3 | 67 |
| 1373098 | 44 | 1432 | 24 | 4 | 68 |
| 1373099 | 44 | 1201 | 20 | 3 | 75 |
| 1373100 | 41 | 1031 | 16 | 3 | 77 |
| 1373101 | 45 | 1236 | 28 | 4 | 65 |

Study 3
Plasma Chemistry Markers

To evaluate the effect of modified oligonucleotides on liver function, plasma levels of blood urea nitrogen (BUN), albumin, alanine aminotransferase (ALT), aspartate aminotransferase (AST), total bilirubin (TBIL) and creatinine (CREA) were measured using an automated clinical chemistry analyzer (Hitachi Olympus AU400c, Melville, NY). The results are presented in the table below.

TABLE 87

Plasma chemistry markers in male CD-I mice

| ION NO. | Albumin (g/dL) | ALT (IU/L) | AST (IU/L) | CREA (mg/dL) | BUN (mg/dL) | TBIL (mg/dL) |
|---|---|---|---|---|---|---|
| PBS | 2.8 | 25 | 56 | 0.1 | 26 | 0.2 |
| 1394140 | 2.9 | 38 | 72 | 0.2 | 24 | 0.2 |
| 1394142 | 2.5 | 67 | 92 | 0.1 | 23 | 0.2 |
| 1394143 | 2.7 | 30 | 55 | 0.1 | 22 | 0.2 |
| 1394144 | 2.7 | 37 | 69 | 0.1 | 24 | 0.2 |
| 1394145 | 2.7 | 50 | 67 | 0.1 | 25 | 0.1 |
| 1394146 | 2.8 | 142 | 203 | 0.1 | 24 | 0.2 |
| 1394147 | 2.5 | 63 | 80 | 0.1 | 25 | 0.1 |
| 1394148 | 3.1 | 219 | 193 | 0.1 | 23 | 0.2 |
| 1394149 | 2.9 | 746 | 757 | 0.2 | 25 | 0.3 |
| 1394150 | 2.7 | 608 | 451 | 0.1 | 22 | 0.2 |

Body and Organ Weights

Body weights of CD-1 mice were measured at days 1 and 39, and the average body weight for each group is presented in the table below. Liver, kidney and spleen weights were measured at the end of the study and are presented in the table below.

TABLE 88

Body and organ weights (in grams)

| ION No. | Body Weight (g) Day 1 | Body Weight (g) Day 39 | Liver (g) | Kidney (g) | Spleen (g) |
| --- | --- | --- | --- | --- | --- |
| PBS | 29 | 36 | 1.8 | 0.5 | 0.1 |
| 1394140 | 28 | 36 | 2.0 | 0.5 | 0.1 |
| 1394142 | 30 | 38 | 1.8 | 0.5 | 0.2 |
| 1394143 | 29 | 37 | 2.1 | 0.5 | 0.1 |
| 1394144 | 29 | 37 | 2.1 | 0.5 | 0.1 |
| 1394145 | 30 | 38 | 2.4 | 0.5 | 0.2 |
| 1394146 | 29 | 37 | 2.1 | 0.5 | 0.1 |
| 1394147 | 31 | 38 | 2.5 | 0.5 | 0.2 |
| 1394148 | 29 | 37 | 2.6 | 0.5 | 0.2 |
| 1394149 | 27 | 35 | 2.3 | 0.4 | 0.1 |
| 1394150 | 27 | 35 | 2.3 | 0.5 | 0.2 |

Hematology Assays

Blood obtained from mouse groups at week 6 were sent to IDEXX BioResearch for measurement of hematocrit (HCT), platelet counts (PLT), neutrophil counts (NEU), reticulocyte counts (RET) and lymphocyte counts (LYM). The results are presented in the table below.

TABLE 89

Blood cell counts in male CD-1 mice

| ION NO. | HCT (%) | PLT ($10^3/\mu L$) | NEU (%) | RET (%) | LYM (%) |
| --- | --- | --- | --- | --- | --- |
| PBS | 53 | 1271 | 17 | 3 | 74 |
| 1394140 | 52 | 1221 | 20 | 3 | 72 |
| 1394142 | 50 | 1249 | 28 | 3 | 64 |
| 1394143 | 50 | 1165 | 17 | 3 | 76 |
| 1394144 | 49 | 1090 | 18 | 3 | 75 |
| 1394145 | 52 | 1292 | 21 | 3 | 73 |
| 1394146 | 50 | 1382 | 27 | 3 | 66 |
| 1394147 | 52 | 1343 | 22 | 3 | 69 |
| 1394148 | 52 | 1286 | 27 | 3 | 64 |
| 1394149 | 46 | 1613 | 26 | 3 | 66 |
| 1394150 | 47 | 1444 | 13 | 2 | 79 |

Example 9: Tolerability of Modified Oligonucleotides Targeting Human HSD17B13 in Sprague-Dawley Rats Sprague-Dawley rats are a multipurpose model used for safety and efficacy evaluations. In this study, the rats were treated with Ionis conjugated modified oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow. Groups of 4 Sprague-Dawley rats each were weekly injected subcutaneously with 25 mg/kg of conjugated modified oligonucleotide for 6 weeks (total 7 doses). 72 hours after the last dose, rats were euthanized; and organs, urine and plasma were harvested for further analysis.

Study 1

Plasma Chemistry Markers

To evaluate the effect of the conjugated modified oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the Table below expressed in IU/L. Plasma levels of creatinine (CREA), albumin, and Blood Urea Nitrogen (BUN) were also measured using the same clinical chemistry analyzer and the results are also presented in the table below.

TABLE 90

Plasma chemistry markers in Sprague-Dawley rats

| ION NO. | Albumin (g/dL) | ALT (IU/L) | AST (IU/L) | CREA (mg/dL) | BUN (mg/dL) |
| --- | --- | --- | --- | --- | --- |
| PBS | 3.4 | 34 | 53 | 0.3 | 13 |
| 1310535 | 3.2 | 35 | 68 | 0.3 | 14 |
| 1371966 | 3.5 | 33 | 66 | 0.3 | 16 |
| 1371968 | 3.8 | 36 | 57 | 0.4 | 16 |
| 1371969 | 3.0 | 25 | 68 | 0.3 | 16 |
| 1371970 | 3.4 | 48 | 101 | 0.3 | 15 |
| 1371971 | 3.6 | 34 | 72 | 0.3 | 16 |
| 1371972 | 3.5 | 51 | 76 | 0.4 | 15 |
| 1371973 | 3.6 | 36 | 62 | 0.3 | 14 |
| 1371974 | 3.3 | 37 | 76 | 0.4 | 15 |
| 1371976 | 3.4 | 31 | 55 | 0.3 | 15 |
| 1371978 | 3.4 | 37 | 67 | 0.3 | 15 |
| 1371979 | 3.5 | 117 | 122 | 0.3 | 12 |

Hematology Assays

Blood obtained from mouse groups at week 6 and was sent to IDEXX BioResearch for measurement of hematocrit (HCT), and platelet counts (PLT). The results are presented in the table below.

TABLE 91

Blood Cell Count in Sprague-Dawley Rats

| ION NO. | HCT (%) | PLT ($10^9$/L) |
| --- | --- | --- |
| PBS | 47 | 849 |
| 1310535 | 43 | 954 |
| 1371966 | 46 | 844 |
| 1371968 | 47 | 1010 |
| 1371969 | 43 | 810 |
| 1371970 | 48 | 1016 |
| 1371971 | 46 | 893 |
| 1371972 | 46 | 1019 |
| 1371973 | 44 | 857 |
| 1371974 | 46 | 930 |
| 1371976 | 45 | 843 |
| 1371978 | 45 | 900 |
| 1371979 | 47 | 1077 |

Kidney Function

To evaluate the effect of the conjugated modified oligonucleotides on kidney function, urinary levels of total protein and creatinine were measured using an automated clinical chemistry analyzer (Hitachi Olympus AU400c, Melville, NY). The ratios of total protein to creatinine (P/C ratio) are presented in the table below.

TABLE 92

Total protein to creatinine ratio in Sprague-Dawley rats

| ION NO. | Urine P/C Ratio |
| --- | --- |
| PBS | 0.5 |
| 1310535 | 0.4 |
| 1371966 | 0.8 |
| 1371968 | 0.7 |
| 1371969 | 0.6 |
| 1371970 | 0.6 |
| 1371971 | 1.1 |
| 1371972 | 0.4 |

TABLE 92-continued

Total protein to creatinine ratio in Sprague-Dawley rats

| ION NO. | Urine P/C Ratio |
|---|---|
| 1371973 | 0.7 |
| 1371974 | 0.8 |
| 1371976 | 0.7 |
| 1371978 | 0.5 |
| 1371979 | 0.8 |

Body and Organ Weights

Body weights of Sprague-Dawley rats were measured at days 1 and 40, and the average body weight for each group is presented in the table below. Liver, heart, spleen and kidney weights were measured at the end of the study and are presented in the table below.

TABLE 93

Body and Organ weights In Sprague-Dawley rats (g)

| ION No. | Body Weight (g) Day 1 | Body Weight (g) Day 40 | Liver (g) | Kidney (g) | Spleen (g) |
|---|---|---|---|---|---|
| PBS | 140 | 464 | 18 | 3.2 | 1.1 |
| 1310535 | 152 | 476 | 20 | 3.7 | 1.5 |
| 1371966 | 150 | 437 | 17 | 3.1 | 1.0 |
| 1371968 | 147 | 419 | 15 | 2.9 | 1.0 |
| 1371969 | 151 | 423 | 16 | 3.5 | 2.0 |
| 1371970 | 151 | 440 | 16 | 2.9 | 1.1 |
| 1371971 | 138 | 406 | 17 | 3.1 | 1.4 |
| 1371972 | 144 | 424 | 12 | 2.7 | 1.0 |
| 1371973 | 141 | 401 | 14 | 3.0 | 1.3 |
| 1371974 | 143 | 443 | 16 | 3.0 | 1.1 |
| 1371976 | 126 | 412 | 16 | 2.8 | 1.0 |
| 1371978 | 155 | 452 | 17 | 3.3 | 1.3 |
| 1371979 | 148 | 458 | 19 | 3.1 | 1.3 |

Study 2

Plasma Chemistry Markers

To evaluate the effect of the conjugated modified oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the Table below expressed in IU/L. Plasma levels of creatinine (CREA), albumin, and Blood Urea Nitrogen (BUN) were also measured using the same clinical chemistry analyzer and the results are also presented in the table below.

TABLE 94

Plasma chemistry markers in Sprague-Dawley rats

| ION NO. | Albumin (g/dL) | ALT (IU/L) | AST (IU/L) | CREA (mg/dL) | BUN (mg/dL) |
|---|---|---|---|---|---|
| PBS | 3.6 | 33 | 56 | 0.3 | 16 |
| 1371981 | 3.7 | 35 | 57 | 0.3 | 17 |
| 1373086 | 3.7 | 35 | 87 | 0.4 | 19 |
| 1373087 | 3.3 | 33 | 64 | 0.4 | 18 |
| 1373089 | 3.7 | 92 | 129 | 0.3 | 18 |
| 1373090 | 3.5 | 38 | 72 | 0.4 | 18 |
| 1373094 | 3.7 | 187 | 311 | 0.4 | 16 |
| 1373096 | 3.3 | 69 | 171 | 0.3 | 18 |
| 1373097 | 3.2 | 40 | 86 | 0.3 | 17 |
| 1373098 | 3.8 | 37 | 74 | 0.3 | 17 |
| 1373099 | 3.6 | 33 | 60 | 0.4 | 16 |

TABLE 94-continued

Plasma chemistry markers in Sprague-Dawley rats

| ION NO. | Albumin (g/dL) | ALT (IU/L) | AST (IU/L) | CREA (mg/dL) | BUN (mg/dL) |
|---|---|---|---|---|---|
| 1373100 | 3.1 | 39 | 115 | 0.3 | 20 |
| 1373101 | 3.4 | 37 | 80 | 0.3 | 14 |

Hematology Assays

Blood obtained from mouse groups at week 6 were sent to IDEXX BioResearch for measurement of hematocrit (HCT), and platelet counts (PLT), neutrophil counts (NEU), reticulocyte counts (RET) and lymphocyte counts (LYM). The results are presented in the table below.

TABLE 95

Blood Cell Count in Sprague-Dawley Rats

| ION NO. | HCT (%) | PLT ($10^3/\mu L$) | NEU (%) | RET (%) | LYM (%) |
|---|---|---|---|---|---|
| PBS | 51 | 709 | 14 | 3 | 72 |
| 1371981 | 52 | 769 | 11 | 2 | 84 |
| 1373086 | 47 | 921 | 8 | 2 | 88 |
| 1373087 | 50 | 764 | 6 | 3 | 89 |
| 1373089 | 49 | 1217 | 7 | 3 | 88 |
| 1373090 | 50 | 766 | 10 | 4 | 85 |
| 1373094 | 53 | 943 | 14 | 2 | 81 |
| 1373096 | 61 | 376 | 6 | 3 | 89 |
| 1373097 | 49 | 746 | 5 | 3 | 90 |
| 1373098 | 49 | 929 | 10 | 3 | 85 |
| 1373099 | 47 | 717 | 8 | 3 | 85 |
| 1373100 | 42 | 823 | 6 | 4 | 87 |
| 1373101 | 48 | 693 | 7 | 3 | 87 |

Kidney Function

To evaluate the effect of Ionis oligonucleotides on kidney function, urinary levels of total protein and creatinine were measured using an automated clinical chemistry analyzer (Hitachi Olympus AU400c, Melville, NY). The ratios of tot protein to creatinine (P/C ratio) are presented in the table below.

TABLE 96

Total protein to creatinine ratio in Sprague-Dawley rats

| ION NO. | Urine P/C Ratio |
|---|---|
| PBS | 1.0 |
| 1371981 | 1.7 |
| 1373086 | 1.5 |
| 1373087 | 1.7 |
| 1373089 | 1.5 |
| 1373090 | 1.3 |
| 1373094 | 3.3 |
| 1373096 | 1.5 |
| 1373097 | 1.3 |
| 1373098 | 1.2 |
| 1373099 | 1.9 |
| 1373100 | 0.9 |
| 1373101 | 1.7 |

Body and Organ Weights

Body weights of Sprague-Dawley rats were measured at days 1 and 44, and the average body weight for each group is presented in the table below. Liver, heart, spleen and kidney weights were measured at the end of the study and are presented in the table below.

TABLE 97

Body and Organ weights In Sprague-Dawley rats (g)

| ION No. | Body Weight (g) Day 1 | Body Weight (g) Day 44 | Liver (g) | Kidney (g) | Spleen (g) |
|---|---|---|---|---|---|
| PBS | 146 | 458 | 19 | 3.1 | 1.0 |
| 1371981 | 141 | 424 | 21 | 3.4 | 1.1 |
| 1373086 | 151 | 434 | 19 | 3.0 | 1.8 |
| 1373087 | 143 | 433 | 19 | 3.3 | 1.3 |
| 1373089 | 149 | 431 | 21 | 3.5 | 2.1 |
| 1373090 | 142 | 453 | 19 | 3.2 | 1.3 |
| 1373094 | 142 | 449 | 19 | 3.2 | 1.4 |
| 1373096 | 149 | 460 | 23 | 3.6 | 3.2 |
| 1373097 | 136 | 400 | 17 | 3.3 | 2.2 |
| 1373098 | 130 | 389 | 20 | 2.9 | 1.5 |
| 1373099 | 152 | 421 | 16 | 2.9 | 1.6 |
| 1373100 | 146 | 453 | 19 | 4.2 | 2.3 |
| 1373101 | 140 | 412 | 17 | 2.9 | 1.5 |

Study 3
Plasma Chemistry Markers

To evaluate the effect of the conjugated modified oligonucleotides on hepatic function, plasma levels of transaminases were measured using an automated clinical chemistry analyzer (Hitachi Olympus AU400c, Melville, NY). Plasma levels of ALT (alanine transaminase) and AST (aspartate transaminase) were measured and the results are presented in the Table below expressed in IU/L. Plasma levels of creatinine (CREA), albumin, total bilirubin (TBIL) and Blood Urea Nitrogen (BUN) were also measured using the same clinical chemistry analyzer and the results are also presented in the table below.

TABLE 98

Plasma chemistry markers in Sprague-Dawley rats

| ION NO. | Albumin (g/dL) | ALT (IU/L) | AST (IU/L) | CREA (mg/dL) | BUN (mg/dL) | TBIL (mg/dL) |
|---|---|---|---|---|---|---|
| PBS | 3.2 | 41 | 62 | 0.3 | 18 | 0.2 |
| 1394140 | 3.6 | 48 | 123 | 0.4 | 20 | 0.3 |
| 1394142 | 3.0 | 57 | 136 | 0.4 | 23 | 0.2 |
| 1394143 | 3.3 | 122 | 201 | 0.3 | 19 | 0.4 |
| 1394144 | 3.2 | 38 | 73 | 0.4 | 18 | 0.1 |
| 1394145 | 3.6 | 112 | 187 | 0.4 | 17 | 0.2 |
| 1394146 | 3.4 | 54 | 98 | 0.4 | 20 | 0.2 |
| 1394147 | 3.1 | 53 | 110 | 0.3 | 18 | 0.2 |
| 1394148 | 3.5 | 45 | 57 | 0.4 | 19 | 0.3 |
| 1394149 | 3.7 | 94 | 102 | 0.5 | 27 | 0.3 |
| 1394150 | 3.8 | 60 | 83 | 0.4 | 19 | 0.2 |

Hematology Assays

Blood obtained from mouse groups at week 6 and was sent to IDEXX BioResearch for measurement of hematocrit (HCT), and platelet counts (PLT1), neutrophil counts (NEU), reticulocyte counts (RET) and lymphocyte count (LYM). The results are presented in the table below.

TABLE 99

Blood Cell Count in Sprague-Dawley Rats

| ION NO. | HCT (%) | PLT (K/µL) | NEU (%) | RET (%) | LYM (%) |
|---|---|---|---|---|---|
| PBS | 52 | 795 | 12 | 3 | 84 |
| 1394140 | 45 | 876 | 8 | 3 | 88 |
| 1394142 | 47 | 768 | 4 | 3 | 90 |
| 1394143 | 59 | 1277 | 11 | 2 | 80 |
| 1394144 | 51 | 574 | 6 | 3 | 87 |
| 1394145 | 51 | 806 | 12 | 2 | 82 |
| 1394146 | 48 | 1052 | 11 | 2 | 81 |
| 1394147 | 49 | 922 | 8 | 3 | 85 |
| 1394148 | 49 | 1134 | 12 | 3 | 84 |
| 1394149 | 46 | 1816 | 14 | 3 | 80 |
| 1394150 | 52 | 1094 | 12 | 3 | 83 |

Kidney Function

To evaluate the effect of Ionis oligonucleotides on kidney function, urinary levels of total protein and creatinine were measured using an automated clinical chemistry analyzer (Hitachi Olympus AU400c, Melville, NY). The ratios of total protein to creatinine (P/C ratio) are presented in the table below.

TABLE 100

Total protein to creatinine ratio in Sprague-Dawley rats

| ION NO. | Urine P/C Ratio |
|---|---|
| PBS | 0.8 |
| 1394140 | 1.6 |
| 1394142 | 1.1 |
| 1394143 | 1.3 |
| 1394144 | 1.3 |
| 1394145 | 1.1 |
| 1394146 | 1.8 |
| 1394147 | 1.5 |
| 1394148 | 1.0 |
| 1394149 | 1.1 |
| 1394150 | 1.9 |

Body and Organ Weights

Body weights of Sprague-Dawley rats were measured at days 1 and 42, and the average body weight for each group is presented in the table below. Liver, heart, spleen and kidney weights were measured at the end of the study and are presented in the table below.

TABLE 101

Body and Organ weights In Sprague-Dawley rats (g)

| ION No. | Body Weight (g) Day 1 | Body Weight (g) Day 42 | Liver (g) | Kidney (g) | Spleen (g) |
|---|---|---|---|---|---|
| PBS | 270 | 503 | 19 | 3.0 | 0.9 |
| 1394140 | 263 | 440 | 19 | 3.0 | 1.5 |
| 1394142 | 258 | 370 | 13 | 2.9 | 1.5 |
| 1394143 | 257 | 393 | 16 | 2.9 | 1.1 |
| 1394144 | 254 | 461 | 18 | 3.2 | 1.5 |
| 1394145 | 266 | 475 | 21 | 3.4 | 1.4 |
| 1394146 | 268 | 444 | 17 | 3.1 | 1.7 |
| 1394147 | 258 | 401 | 17 | 3.2 | 2.0 |
| 1394148 | 267 | 447 | 21 | 3.0 | 1.5 |
| 1394149 | 261 | 422 | 20 | 5.8 | 1.4 |
| 1394150 | 251 | 423 | 18 | 3.0 | 1.2 |

Example 10: Measurement of Viscosity of Modified Oligonucleotides Targeting Human HSD17B13

The viscosity of select conjugated modified oligonucleotides from the studies described above was measured.

Conjugated modified oligonucleotides (within a range of 32-38 mg) were placed into separate glass vials; approximately 100 µL of water was added to each vial, and the conjugated modified oligonucleotides were dissolved into solution by heating the vials to 55° C. A 75 µL portion of the pre-heated sample was pipetted to a micro-viscometer (PAC Cambridge Viscosity Viscometer). The temperature of the micro-viscometer was set to 25° C. and the viscosity of the sample was measured. The 75 uL portion of each sample was then combined with the remaining portion of the original sample, which was then diluted for UV reading at 260 nM (Cary UV instrument). The data is presented in the Table below. Compounds having viscosity of less that 40 cP in this assay are generally suitable for use in therapy.

TABLE 102

Viscosity of modified oligonucleotides

| Compound ID | Concentration by weight (mg/mL) | Concentration by UV (mg/mL) | Viscocity (cP) |
|---|---|---|---|
| 1310535 | 300 | 206 | 6 |
| 1371966 | 300 | 223 | 10 |
| 1371974 | 300 | 207 | 8 |
| 1371976 | 300 | 254 | 64 |
| 1371978 | 300 | 219 | 7 |
| 1371979 | 300 | 244 | 10 |
| 1373086 | 300 | 215 | 7 |
| 1373087 | 300 | 219 | 9 |
| 1373090 | 300 | 191 | 8 |
| 1373097 | 300 | 222 | 6 |
| 1373098 | 300 | 203 | 5 |
| 1373099 | 300 | 242 | 6 |
| 1373101 | 300 | 205 | 11 |
| 1394140 | 300 | 197 | 10 |
| 1394141 | 300 | 225 | 9 |
| 1394142 | 300 | 271 | 24 |
| 1394143 | 300 | 250 | 11 |
| 1394144 | 300 | 257 | 32 |
| 1394145 | 300 | 263 | 10 |
| 1394146 | 300 | 289 | 11 |
| 1394147 | 300 | 246 | 15 |
| 1394148 | 300 | 205 | 9 |
| 1394149 | 300 | 304 | 14 |
| 1394150 | 300 | 202 | 16 |
| 1394151 | 300 | 223 | 8 |
| 1394152 | 300 | 225 | 24 |
| 1371976 | 200 | 151 | 16 |

SEQUENCE LISTING (3007 sequences)

SEQ ID NO: 1 - RNA, 2397 nt, Homo sapiens
  source 1..2397: mol_type = mRNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 2 - DNA, 25000 bp, Homo sapiens
  source 1..25000: mol_type = genomic DNA
aggaggctgaggcacaagaatcacttgaacctgggaggcggaggttgcagcgagctgagattgtaccactgcactccagcctgggcgatagagcgagactccgtctcaaaaacaaacaaaacaaaacaacaacaacaacaacaacaaaatcaagggacaaagtgtatgtttctagcattgttggggcaaatatgaaccctgtaattgaggaacatgaacattccgtcccatagaaaacaagcaaaaagaaaaaaaaagagagagagctcactaggttgtctcatatgaaataaaatttctcagcaaccaaactatttgagaacaatgttaagaagtgttgttcactgtctcaaagattcttaattcttgcataatacaaatatccagtgggtaaaataatctagattccactgtaaattttaaaactgcctttcaaaactgcatcagtactgtattgatttagatagcattggtctggccccctctgagcaagctggatattcaaatatagacattcaatctgaaaacagattcctgcactgcagcccagcatgaggtctgatctaaagcacctatgtcaatatttaacagctccatatacatgtcacagcaaacctgcatgcagaaagatataaccaagtactatttttttgccataaatttatccaaggttcaaactgaaagaaccaattacactgtctccaatataatataagtataggccaggtctcaaccttagttgagggtactcacgtttgggctaaataattcttggtttcaatgcacaaggctttcctatgaattgtaaagtgttcagcagcttccctggcctctacctattagatagatgacagtggcatgcctaaattgtggcaacaaagaatgtctccagacatgccaaaatgtaccctgtggaacaaaagtaatcctagttgagaaccactgatctaagttaaaagttgaggctacagcatcaggcttcctgggtttcaatcctcactccacctcttgccagctgttactttatgcttacaaataagttacctaacttgcctatacatcagtttccacatctgtacaatgcagattttaatagcacctacttcaaatgtatgttgtgaagattaaacaagttgatatgtaaagcccttaaatcagtccatgatatatagtgattaacacattcgcattcttactataattagtatttgatttatataaccattcactacttgcaaaactatttcataaacatattctcttatttgatccttatagccactttgtgtgttggcatatgagggaaggttgaggttgttatgtgctctgaaggtctatgttgggtaatgtgtgcttttttaaaaaatatctattttctagttaaggaaactgtagcatagagaaaataaataggattgctagaaatcacacacacgtaacatacaatttaccattttaactattttgtaatgtacagatcagtagcattaagcacattcacattgttgtataaccatcaccaccattcacctgcggagctttcatcatcctaactgaaactccatactcattaaacaataattccccattccttttctcctcatcccctagtaaccaccttactgctttctgtctctctctgtgtatttgactactctaggtacctcatataaatggagtcatacaatatttatacttttgcatctggcttatttcacttagcataatgtcattaaggttcatctatctagtagtatgtgtcagaatttccttcctttctaaggctgagtaatattccattgcatgtatatatcatattttgtttatctgttgatgaacactggggttgttcccacttcttggctattggaagttgctataggctgcatgtgttccttcaaaattcatattatgaaatcctatctcccagtgtgatggttttaggaagtgagacctttgggaggtgattaggtcatgagagctctgccatgggaataattgcccttatacaagagaacacggagggtttccttcctccttctgccacttgaggtgacagtgaaatgacagccatctatcaaccaggaagccagctcttaccagacaaagaatatgccagcgccttgatcttggacttcttgtgagaaataagtttctggaatttataaaccacctggtcaatggtaatttgttacagcagcagacaaagacagaagccaccccactttaaagttgagattcccgactcctggtctaatgctctttccagtattatcacaaagggaactgatggttctgtatcctaaaatctcccccaaactcaagagattttcagggaaatggtcatcatgtgtaaaataattagccagttgaaatattgatgctgagcttttgtgaataaatgaatcaaatagctaagctgggttcattcagactttatctaagtttctttaagcttatctctacattctcctttttcatattgaaaaaaggtaacaatttccagaaagataccaacagatcattagctgatgcagtatctccagaattctttttcttttttttttagaccaggccttgttctgttgcttaggctggagcgcagtggcacaatcacagctcactgcaccacgaactcatggactgaagcaatcctcctgcctcagcctcctgggtagctgggactacagacacatgccaccatatccagctaatttttttctatagtttttttttttttttttgagacagggtcttactatgttgcccagactggtctcgaactcctgggctcaagcaatcctctgcctcagcctcccaaagtgctgggattacagatgtgagccactgcacctggcccctagaattgtttctagaggtgaaacttcaaggtgaaatatagtacataactgcttttcagataaacaagtccagagagcacactctcttgtgctcttggcatcacttggcatcacttcatatttgaggtgtttcaaacccattagaacacgtgaacaaggcctgcttccaaagctggcttccatctggtagtcccattaacaactgggcacaccccttccctagagctctgtgtagacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtaatgtatacatcttccaactttttaaagtcacagagtaagatatgtattttaagaattatttgacttaccatctacttatctttgtatttttgtttttcaaagtttgataaattccctggtcccttagtctgtatatgtgtcaggttagttagatgaagggaatgtaattaagaactaagcagcgatttttatgacatggtgtgcaggttgatagaaagactcaggagccagtctccttccaagctgctaaatgaggcaagtcacatattatctctcagcctgttttcttggctctgaagtggggataataacttaggggatgggcaagaacgggatctgaaaattacagctacaaacaaaagtcaaacgaagaacttgcaacagaaacctttagtgcctcccctcatgcacaagcaacacagttctaaaatatttactgtctgaccctttacagaaaatgtttgccagtccgtagtcaaaaggattaaataagtaatattttcagcacttagcatatgataaacgatacgtggcacatgataaacaataactgtgttaaataaaatatgtgcgcagtgagtcaggcttttccttggacattagtatttttcctgtgttcttacttgtaaacactacattaacaaccccaaataaaactgaaggaactgaaatcttgtatcattttctctaaacttgtaaattctggtaaggccatgaaaatatatgcagagaagtgtttacaggattttaggattggaaaaattgtgaagtactccttgagaatcacattttctgcaaattacagtggttttaattaccattatattattactttctcatgttctttgctgtcatgtttagttgaaacctaaaatgtctcttacacttagagaactaattcttttctgttttttttctgaatagtgaagaatactatacaaaaaagctactacatttttatttaacagatatgagcatttatataatagaggagttgatgtatataaaaatgatttgccatctttttggtctttgaagaaattcgaatgaactttctggaagatagcaagaatttacaaatagagaaaattgttgcctgctgttctcaggcatttgtccaaaaatataaataagtataaatctatgaaaagggcttgatgaaatctaaccttcaaatctctttccagatgtgtatttttggggaaagggctatatttattaagttttttttaaattttaaaatttccagagacaagagaaaagtaaattagaaggaagtcgtattaaaaatgacttaagggcgggtgcagtggctcacacctgtaatcccagcactttgggagacggaggtgggcagattgctggagcccaggagttcaagaccagcctgggcagcacagcaaaacccccaactctacaaaaaatacaaaaattagctgggtgcgggggtgcacacccgtagtcccagctactcgggaggctgaggtgggaggatcgtttcagttcaggaagccaaggctgcaatgagctatgatggcatcattgcactccaagctgggcaatagagccaggctctgtctcaaaaaaaataaaaaaagacttaagaaaaataggtaacccaacctcaaaaattctctttgaatcattaaatttcatggttaaacatttaagctactgaatgattcactctaaggctgtaatgtaactcagatctcctttaggcgaggaagatgctggctgagttttcatcataactggctccttttgccctgtgagatgagagacacagtagcagtttggctcttatgcaatctaaactgttgcgttgggaatacggttcaaaaaacacattggagtttaagctaaagcaagtgttttgctaacaaaaagacaaggcatcacattttgcaattgtctagctcagttataaaacagaagaataggccggacgcggtggctcacgcctgtaatcccagcactttgggaggccgagacgggcggatcacgaggtcaggagatcgagaccatcctggataacacagtgaaaccccgtctctactaaaaatacaaaaaaattagccaggcgtagtggcgggcgcctgtagtcccagctactcgggaggctgaggcaggagaatggtgtgaacccgggaggcggagcttgcagtgagccgagatgacgccactgcactccagcctgggcgacagagcgagactccgtctcaaaaaaaaaaaaaaaaaaaaaactgaagaataattaattcttcaatcaaaacatctgatgaatgctctggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaattgctctgtctccatgtcctatggttatgggcaagtttggtacataaatgagaaatccatccagtggccttgcccatctcactcccaaacacctgaagaatgtaatgttatatctcctagagtagcagcatggtctccctatgaaagtccttcttctttaaggagacttctttcccttccctcctaggaggatgagtcagaatcatcaagaaaaatatgatgggcagaggcatacagtttaccattaccactagtttagaattactacttagcactttactgcctattacatagttggtgctcaacaaatgtatgataaattaatggttgagtttttctttcttctccatattcatcttccatgacaccacgaagagcaatgtttttcaagaatgttcttcaaggtttgaaagtagcctgctttagagaaactgcctactgtacagcctccaaccaagaggaaaagctgaaaaaagcatgaagggattttgttttgttttgtttgttttggttttaatatgagcattccctggcagaaaagccaggggtaatctcattgcaactaggcaatcactctcaagaaattttctaacaaataaggaggccaatttttattttattttgagacgaagtcccactctgtcacccaggttggagtgcaatggaatgatttcagctcactgcaacctccgcctcccgggttcaagtgattctcctgtctaaacttcccgagtagctgggattacaggctcccaccaccacgcccagctaattttttgtatttttagtagagatggggtttcaccattttggccagactggtctcaaactcctgacctcaagtgatccaccctcctcggcctcctaaagtgctgggattacaggcgtgagccaccacacctgacccaggaggccaatttttaaaaggttaactaatcttcatgtccaaaatgaatgttaattgttcattttggacatgaatgttaattttttttttttttttttttgagacagagtctcactctgttgcccaggctggagtccagtggcactatctccactcactgcaacttcctcctcccaggttcaagcaattatcctgcctcagcctcccaagtagctgggattacaggcccacaccatcaggcctggctaatttttgtatttttagtagagacggggtttcaccatgttggccaggctggtcttgaactcctgacctcgtgatccgccctcctcggccaaccaaagtgctgggattacaggcgtgagccaccgcgcctagccgaatgttaattgtctaaaaatttttcttctccaatgtcttctcctccacttttttcggaatttgtttcttcctaattacagcgcggtgtggaggaaactgcagctgagtgccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattggattttagctgctaactgaagtagttatgtcaccaaggaaggatatatactttttttcttgtatgtaatccactcagctctgcccattattattgttcatattattaatcaatttcattctgatcagaagtgtgagcagtggcacagagtgactgacaaaagatttatcatcagggaatatggatcacttcctagttttgttttagtcctattaactttgcagtaattccagcttctctttaattatttcccttgtgagattttattttggtgttaatgtagtcttctgtagaaaatgtaatattaataattattatcacaattattttaaaagagtaaataccaaataatcacaatgaactaagcactctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctctaaaaaaaaaaaaaaaaaaaaaaaaaaaagtttaaagaaaaacacatttttaaaaaatgaacactttaaaaatatttggtcagaatttatataggaatttatcaacataaatgttaatttcactttactgataaacttgcaaaacatgatgtgctgggtactgaaatttagatgttaaaagaacagtttatcccacctttatgacagtgttcccttggcctccacgatttgagctcaacagtctgtcttgcctgaactctgagagacctcatacaatagaagaaagactctcatctttggattatattggtcccaaaactttgagtttgaataatacacccagtgaaagtgttctttcaatttcaaaaggtgaagaaagaagtgggtgatgtaacaatcgtggtgaataatgctgggacagtatatccagccgatcttctcagcaccaaggatgaagagattaccaagacatttgaggtcaacatcctaggacatttttgggtgagtgtgagtcagaaacatttctgatttgtgcaccttctcttaagatacatgaaacttataacggagttcacatacttctggacaggaaactggccagatctttgccttaatcaagaatcattaaatttgtttgagtagaagagccacagagtctctgacacaaggacacagaattcaagtggacacaacacaccagaatgtaagctacttggtctgtcttgtccaccagtatctgacacaaagcttggcatgtaccaggagctcaacaaatgtttgtggaggtttgttaagggttgtcagtgtacatcttttcaatgctgtcacttgtgacttcatttttttccctccacaccatgattttgtaatgtgtcctcattttgtggaattttagaatggaaaggacatcagaagtaattacttggatgtatataggatcgaggacacttttggacgagactctgaggcaagtgttctagatccatggggtgctggaactgagaaatgcagctatacagacctcatataattggttagttttgtgggagatggaaatatcaacttcaactgcctttgtatagaaatttttatgattaatcttccagtgcctcaatattagtgtagaatctagggcagatctggattctagaagaaagaagaaaaaaaagagatgtgtcccccttacctttaccagctcttcacatatgtgaattggctcccatgcccaccaaactacacggagacctcatacattagctacctatagctgcataacaaattatacaaaacttagtggtttaaagcaacaatgtatgttcactatcctctcacagtttctatgggttgggaatttggaggtagcttgggttgggagttctagttctatgaatttgcataggatttattaaattcttataaaattttattgatgtttctcacaaaagaggtttttggaaaaaaagaaagacttgttttctgtaacatcaacatataatatacaatattacaaatagggagatagtgaattcaatcatgattcattagtgtggtgtagaactctcagcttacactactcaactgtcttaatacagttacacaagatttcactcttttaattagaatgataaagccccaaaccaaaaaattatatgacaccaaattatcataaggaataattttagttctgaaaactctgaatttttcccttaatattgtttagatgacatatccaaaaaaggatctatttgattccttctgaagggaaggagggggagtactgagattagtgttggcatggggcttaccataccaataaatttgtatctttatttctatcatttgtaaagaattaatcatggaatgcttggaagtattttatttcattgtataagttctctcaaatgcctttctgtcttaacaaaaataaaactacctgatttggaaacctaacgtctatgtcattgtctttcttctttctgcaatgatccttaagatcacaaaagcacttcttccatcgatgatggagagaaatcatggccacatcgtcacagtggcttcagtgtgcggccacgaagggattccttacctcatcccatattggtaagtatcacatgccagccatgttatatatttttatactttgaagggagcattacacttcaaattgttaccactggagagtcctggttcttggcatcttgaacaaagaattggacaaaactcaccaacaaagccaggaaagaatgaagcaacaaaagcagagatttattgaaaatgaaagtacgctttacagggtgggagtgggcccaagcacaggggctcaagagccaattacagaattttctggggtttaaataccccctagaggtttccactggttacttggtgtacgccctatgtaaatgaagaggatgaattaaagttacagagtcgtttactcagtgtacaccatatgtaaatggagaggatatttcctgtcatagctggagtgtttccatttgatttagttctaggaagtcagcatgaatcggccttatgttccctgcctccagaccctgttctcctgcctcaagattacaatgctgagagcagagtgatttggatttacagaatttaaatttatagtagtttagaatgattttttaaatgactttttctaaaacaatgaaaccaggttgtaattatatttaagatatttttagatttctgcaaactcctctgtagaacaatgagagaaaacagtaatgccaagcatgtttccattgtttcctggaataagaaacagaaaccccacagactgagaagcaaaacctacagaagctaaaatgaacacatgtctatgtcatggccttggtgcccaagataagacaatcagagtggtccctggatcaaaacattttacagtgtgcttgtgccatgaaagtgtgtgtgtgtgtgtgtgtgtgtgtgtgagagagagagagagagagaaaacgactctacctgactaaaagttgcagataccacactccatgcaccaccaaagacataaagggaaggaggtgagaggcgttaaggatgtactgctgtatttgccaaatatcctttcctgtaaactcttctccagatcctcataataaaattaagaggccaaagtggcaaccattgtcaagagaaaaactatcaaccattgtcaagagaataactcagttattgagagagagaggagaaatgagcagagtcctacagaagtctgtcaacacagataccagttttgtagaatttctaaatgtatttttcctgattcatatttttcaaaataaaagcagcaataaaaactgattagaaaacagtttgaagattcaatggaaaaaccttacatgtaggatggaaaactgaacattaagccaatcaatagagttatttttgttcttttgttatcattgttgtttaagaaatgagatacgttcacaattctgcttaatcatgtaagaaaatgaaaatgaattgccatttatactctcagaaaaatcacaagtggctgatttttggcttccacttgttcttaagccaaatgataccgccttctcacagaaagctgaggattggtttcactctcccttagctaacaatgcttaataattctcttacagttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtaaggtcaaaatcaagttagaatgggtatgtggtatgataaattgatatgaaaactaatgagaaatgtttaggcaggccaactaatagaagaaaatgaagaaggaaaaataatttttcttattattattattatcttgaaattaaaggaataaagggggaaaacacattagggactagcaggaatgatcagccaccgatgaactgggatatttatttgtgtccgggagaaagcacatacatttgatcaccgttaccaccctgtctttaaaatgcaaatgttccaaggaccagcaaataaattgagtatctagctccttagtcaaggtgaatttctgcaagaactcttgtctctggtgagacaggatttgagaccacaagagaagaaaaattagtcctgaaaggagaagaaaaaagcaggaaggtgtggataagaacccgaaaattaagccatctgcttaacaaatttttctaatcctagtatatattctgctgcaggttaacaaaatatactaagcttaatgattcgaaaccaattttttactggaagggaattaatcctaaatatattcattcaaaagaactaaacaattctctgttgagtgccgcctcatttgaggatactgactcttacagcctgagttagctatgtggtctctgcagctggaatcactccctgccactggagtccttcatggtgttagaccataggtactgttgactaaagaaaaaaaaaagtttttgtttttatttttgttttttttgagacagagtctcactctgtcacccaggctggagtacagtggcgcgatctcagctcaccgcaacctccgcctttctgggttcaagcaattctccttcctcagcctcctgagtatttggattacaggcgcccaccaccacgcctggctaatttttgtatttttagtagagacggggtttcaccatgttggccaggctggtctcaaactcctgacctcaggtgtcctacctgccttggcctcctaaaatgctgggattacaggagtgagccaccatgcccggccaaaaaaataagtttttaaagaattaaaggtcatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaattaaaggtgttaattttatttagaagccttactgaagactacagtcggaggcctatagcctgagagcagccctttagagaggttcagttgaactgttctgatagtgggggccatgtgctctatcctgtattgtcttcaaagcatctttccagagagctgcacattgtcacagagtcagggactttgtgaaattatgctgacaaccagaagtgagtaaacgtggcttcttacatttgctacgttgtctcacagtacttaataagtatgcaatatgtaagtaaatactatagtactattgcaactcctgattgttttcttagacaaggaattgggcccaataaaaaccctcttggtaggcattcaggcttcgtgtaccatgagctttcctaagggtatcctgccactcttggggaaggcatgatagatgaggggagtaaggataatggaactctgggtacagggttcctgggggctaacttagaggtagacacaggcaatgctaaatatttgggattgattttatagaggttgctagattgtgaatttccttagtaagggctaaggcattgatatgtaatgtcacacttggctccgaggctgggttgttggatccatgtagatgaaatcagggagagaaagggcagaacggagtaatttagaaatgtattgatttgtattactctctgttggcttgctattcaaggcagtggagaactcaatcacataataatctgcagcaaaccacagatcatcccagggaatgaagttttaacattcgctggctccctaactcctcacccagcctttacattcactggctgttcagtccatgcctggacatcttaatttgaatacaacattttaaatccatttttctgtcatcatcttgcactaacagacaattctacactaagcctatgtttatgaatatttctcaagagtacatgtacacagccttcagtataaggaaaactggaagtatgacatacctccagttgtcatactccttgggcccctcttaaattctcattaaactgcaggataggcaagtcagaggtgaatctcaaatacgaaattcttaccggaaaggggttccaatccagaccccaagagagggttcttagatttctcgcaagaaataattcggggcaaggccacagtgcaaagcaaaagcaagtttattaggaaagtaaaggagtagagaacagctactccatggagaagaatggcttgagctgctccaccaagggtatttagagttacttcttgattatatgctaaacaaggggtggattattcatgagttttccgggaaaagggtgagcaattcccagaactgagatttcctcccctttttaggccatatagggtaacttcctgccattgccatggtatttgtaaactgtcatagtgctggtggaagtgtctcttagcttgctaatgtattatagttagcttataatgagcagtgaggacaaccagaggtcactttcatcaccatcttggttttggtgggttttggccggcttctttactgcaccctattttatcaacaaggtctttatgacctgaatcttgtgccaacctcctatctcatcctgtgacaaagaatgccttaacttcctgggaatgcagcccagtaggtgtcagccttattttacccagaccctattcaagatggagttgctctgatttaaacgcctctgacaaaatgacgacctcaaaacaatccagctttatggaatacctccacaagaaagaaagtatacttagctatagaattttctccttgcatccaacaggctttgagatgtcagatgtttccttcctgtcccatgattaatcctagccattcctctttcttgtctggctccactactccttaccatctaatgcctcgccaccattttgatattttgactaagtgagctatgaaacacacctactggatatgaaagtataagtttctgataacaaaacatcaacatgggatgtggaggaagtgggtagggtggcattaatgcagcaaatcctggaatattttaaatcttcattctaaatttagtaaaaatataggataattttcctgccatcatttacttataaaattaaaattttagaaaataaaaataatattttcctctttttaatcacagattatggcctgtattggagacagatgaagtcgtaagaagtctgatagatggaatacttaccaataagaaaatgatttttgttccatcgtatatcaatatctttctgagactacagaagtaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttttttttttttttttttttttttgagacagagtttcacccttgttgcccaggctggagtgcagtggcgtgatcttggctcactgcagcttctgcctcctggcttcaagtgattctcctgcctcagcctcccaagtagctgggattacaggcacctgccccctcgcccaactaactttttgtgtttgtagtagagacagggtttcaccatgttggccaggctggtctcgaactcctgacctcatgtgatccacctgcctcagcctcccaaagtgctgggattacaggcatgagccatcatgcccagccctatttgacggtttttgacgctaatgcaagtggcattttaaaaaattttatatttcccattgtttgttgtcagtatatattggatttttgtaatttgatctcatattttgcagtcttgctaaattgctaaacctctttttgctaaactcgataagcttttttttttttggtagattcctgggcctctaattttctttatgggaaagtttttaattacaaatttaatttctttaatagctacatggctattcaatttacttattaattcttggtaatgtgtgtctttcaaggaatttgtccatttcatctaagttgtagaatttctttggcataaatttgtacataacattcccttattatccttttaatgtctttagaatgtcttatttatttatttatttatttttattatatttttttgagacagagtctcgctctgttgcccaggctggagtgcagtggcacaatcttggctcactgcaagctccgccttctgggttcatgccattctcctgcctcagcctccctagttgctgggactacaggcgcctgcaaccatgcccagcttattttttttttttttttttttttttttttttttttttttttttttttagtagagacggggtttcaccctgttagccaggatggtctcgatctcctgacctggtgatccgcccgcctcagcctcccaaagtgctgggattacaggcgtgagccaccaagcccagcctatttatttatttagtagagacagtctcactttgctgcccaggcaacaaaggttttgaatgcctggcctcaagcagtcctcctgccttggcctcccaaagtgctgggattacaggcatgagccactgcacctggccaaatgaatatgctgataatatcttctttataaggatgacataagaataaaataatgtaatacaaacaaagcccctgtcactgaaaatgtatagacttcaaatgttaaagtcttagagaacagaatttatatgaaatagcaacagcaacaatttcccagaggaaatactctctcagctttcttctgaggagcagtttctaaattgaaattgtatcagtgagaagataactatactaacttcataagccttgggcctttttgaaacaaatccatataaactatgaacaaacttgaaatagaacaatttgagaacagggtacaaactgcattggtgtatcaatttcagtatttggttttagcttaaatagactgacttgagataacataaggagaaccttgacccccaagcaacatcatctcgcgagttgactaggccgggtgtggtgtctcacgcctgtaattccagcactttgggaggccacagcaggcagatcacttgaggtcaggcattcgagaccagcctggccaacatggtgaaacctcagctctactaaagatacgaaaattagcaggcatagtggcctgcacctgtaataccaggcactcgcaggagaatcccttgaacccggaaggcggagattgcagtaaaccatgattgtgccactgcactccagcctgggcaacaggagactctgtctcggaaaaataaattttttaaaaaaatgaaaaaaaataaaagttgactaaattagtgtcttggtactaagcactgtaggaagtgagtttcatggaaccccaactctcttggggcccaaagcaagtcatattaatattgaaaattacatgcatatacatgcatatgaccaaggtgataaaaacaattattctgcctgagttggagaatagtatcccagtaaaataaacaagagtctcaaagtcttttgtatcctttgaagctgtcatggtggtttgtaactaggcaacaggtatatattgttaatcttctttgcatttaattccttttatagagagacacaattttacgagcagatgcaattactagcatgaaggtttctttgtgagggtagttaaaaggcccacatgagctctcttcttatccttgtccttctttcagccagatcttccctgcccctttgctcattccatctttcacccacctacccccaaaacaaggaagtaaatcttgcattagtcaacaataccaaagtgattttcaatatgactttctctgcagaatgttattatttctgcctctttacattcacatactgtcttcctttttttttttttttttttttttttttttagattgggtctcactctgttgcccaggctggagtgcagtggcttgatctcagctcactgtaacctccacctcctgagttcaagcaattctcctgcctcagcctcctgagtagctgggattacaggcatgtgccaccacacctggctagtttttttgtatttttagtagagacagggtttcaccatgttggtcaagctggtctcgaactcctgacctcatgatctgaccacctgtgcctctcaaagtgctgggattacaggcgtgagccaccgggccagccactctcttcctttcagttgcctactcatctcttatgcattcctggacatcagttgtccttttgaagctttcctccactatcccagcccatgtgaatcctccttccagttatagcccttaattctagatggctgatatttttcaataattgttttaagatgaccattttagcctatcagctaaacaatatcaaagacaatagctatttttcaagtactttagtttaccttattatagagtgcataatagatattcagtaaatagtaaaggagaggtgaaggcttgcatagaatggattctggtggtgtctcttggtgagcttttagcatcaagattaatcagcagtttcagcaatgagctcagaccttcagttttagatctttactcatatcagataagagagtgagaagagtggtatgtatcagtgctttatttatatttgcatccaatttgaactatgaatattacaaaggtgcacacataggttcagacagattgatttaaaatgaccaaagatgacctgtcgtaagcaacctgggtatcttaagatgcactccttggagagggaatgttcctaaaaacattttcagagggacgaactgtatgaaattcagtaaaacataaatcatgaggaaaactgattactctctttttgacatgaaatgagagttttaatgcatggttacgattattaacgtactccgctgcaagacgttaataaagttactgttttgcaggctagaatgtcttgatgctgtaatcagaacacactttttcccctttcttccagcttcaaatgcagattcataattgggctgacttctaataactgcaatgttttctgccttgggcttgcagcagaagcctgacaaaatagtgtttgtttaggcaataatttatttatttatttattgagatggagtttcattcttgtcgcccaggctggagtgcaatggcgtgatctcggctcactgcaacctctgtgttcaggcaataatttagactttaccttacttgtgattactatagcaattactatagccacaaggcataattttactgtctcatttcaattttatgaatttgaatgtttttacacttttcctaatgaagtccactatgaagttatgtcaaaaaaaaaaaagaaaaagaaagatgcacacgtaaaagagaggtggttgcaagagaagaaaagaacggaggaaagttaaacgcaaaccagataactctcagcgtattctaaatgaccaaaaacagaactctgttgtcaaagattttaaatggaaaatttttcaatttttttttcttttttgtacaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctgtctctatgagtgtccttcaagaaccaaggatgtggatggtaacagctacatctggcagttattaaatgaatccaggggttttctcaactctggtttctttgacagcaggagtgctggtttatcaactggaacttactgacccctttctatgtgtgagattaagcacagtgctattgtttctaattttttttcttagtcaccggcaataatttttttcataacattcttttaatttcttgccttataatcaagaaatttatgagtaaaatgtattatttttaaagtatggttacaaaaattcaaaagagaaacatggaaagtaaaaaatagaagcttacccccagcaatcccatttcccagaggtcacactgtcaatgcacaatcttccagtcttttactgatgcatgttcatgacaaatacattatattcttattgcatgggtcgtatcagtagtttcataccatacattatgttctgtaacttgctcttttagcttaccaacttatcacaaacagctgtttgtttcagtatagagaattcaactttttttcatgagtacacagtactaaaatggtactctaaccattcccttttgataggcacttaggatgtttccagtatttcttagttcatctatttaaatattaatttaacaaatactgagtgccctcaaagttctaggcccagggaaacatatatgaataaggcaaactccttgtcttaacagagctcacattctagtaggtgggacaaacaataaagggactgcaaatatgagagagagcatttaaagtagtagagtcagggaagagcacgctgagaaagaacattttgcggacgaactattaccatacacaggcaactaaaaaatattttatgatatacatattgacaaaaatagaaacctcttaaattccagtgttaagttcagagcagaaaacttcttattttaattccattttggttttaatcttttatgaatgaagctcagagaaatgtgcgagcaaaatattcatctctctttgtccatttttcttgcttattttgagtgtagtcctcctccttaaaagttccacctgcagccaggcgtggtgactcatgcttgtaatcctagcactttgggaggccaaggggggcagatcacctgaggtcaggggttcgagaccagcctggccaacaaggcgaaaccctgtctctactaaatatacaaaatttagctgggcatggtggtacatgcctgtaatcccagctactcaggaggctgaggcaggagaatcacttgaacctgggaggcggaggttgcagtgagctaagatcacgccaccgcactccagcctgggcaacagagtgagactccgtctcaaaaaaataaaaagctccacctgagcttccaaatgttttcctatgacaatcttcatctataattctctctaagagccctctctttcaccaaaatcccagttccaagggctactgctaggatgtgcagatcaccagacaaatatttttttgcagggcttctatctatataaacacttttattaaaaatgctttataaaatttataggtccatgtgcatgcagtatagtgattttttgataaagatttagaataataggaagatttgtgtatttattgtccgagcagtacatgtaaagattcttctcggcatcctggtactatctctttggtccaggaatcatttcttttttatcaaatgagccattcctagctaatttcatatcttttaccacaagaaagggtagcaatgctgttattattcataatgccatggctctttgtaatatgtttgtaataaaataatatgaatcttcacccctttccaataccctgctaccatttatttaatcttagctacattatgccttttgacattgcatcatccattgtgctacccatgaatactgggtatcactcagagacaatcactcaaagattgttactggtacaacacagttcaatatagtacaattgttactggtacaatgtttgatgataatcacaaattcaagtcttacccagggtatatatacgagaaaacatgaatgattcgttgtttattgctcattttaaatttatcatttagaatgttatagcatcacatagaacaacacatctttcaactgtgtcttgtcttgaactttttaggccatcatcattacatttctagaattgatctctgccactcctgaccgtaccctacctcccacacaccaccagcagcagagaggggattgtggacagaacaaaatgaacagccccatttgcacaaggaatgtctgtccctcctctaggagagcttaacattgaccagggagaagagaacacagcatcatcacatcagtcagaaaggcccactgttgtgaagaagcaatagtcttaaaagccctcagaagagataagtgcagccaccccccaacccccagccaaaaggactgcctgacccatggcatagaacctgcagaggggataggatgattttcctgaatgccattggcaagcggggtaaggacatctgatgtcaccctgcagcccttggatgttatatagcagaagtggcatcatactcagaacaaactgcgagtggatgcatgggtcaacacatgcggcttgggcagtggaccttagatagcttacaaccctaaattagatctatgcccaatgtgagtgagaattatccaaaatcagcatgtcagcatcattctggcagccaaatttcatgtaatcctgcaaaagaaattctttgccaaccagaagtagcagtct

SEQ ID NO: 3 - RNA, 2398 nt, Homo sapiens
  source 1..2398: mol_type = mRNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 4 - RNA, 2289 nt, Homo sapiens
  source 1..2289: mol_type = mRNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 5 - DNA, 25 bp, synthetic construct
  source 1..25: mol_type = other DNA
agactacagaagtttcttcctgaac

SEQ ID NO: 6 - DNA, 22 bp, synthetic construct
  source 1..22: mol_type = other DNA
catctctggctggagcttattt

SEQ ID NO: 7 - DNA, 24 bp, synthetic construct
  source 1..24: mol_type = other DNA
tttgaagcagtggttggccacaaa

SEQ ID NO: 8 - DNA, 16 bp, synthetic construct
  source 1..16: mol_type = other DNA
ggaggaggtactgtct

SEQ ID NO: 9 - DNA, 16 bp, synthetic construct
  source 1..16: mol_type = other DNA
gatgttcatggctttg

SEQ ID NO: 10 - DNA, 16 bp, synthetic construct
  source 1..16: mol_type = other DNA
actccaagtaggagta

SEQ ID NO: 11 - DNA, 16 bp, synthetic construct
  source 1..16: mol_type = other DNA
gctccagtaatgagaa

SEQ ID NO: 12 - DNA, 16 bp, synthetic construct
  source 1..16: mol_type = other DNA
atcccacagaaccaat

SEQ ID NO: 13 - DNA, 16 bp, synthetic construct
  source 1..16: mol_type = other DNA
tagttttcggcactca

SEQ ID NO: 14 - DNA, 16 bp, synthetic construct
  source 1..16: mol_type = other DNA
agagcgatagatctct

SEQ ID NO: 15 - DNA, 16 bp, synthetic construct
  source 1..16: mol_type = other DNA
ccacgattgttacatc

SEQ ID NO: 16 - DNA, 16 bp, synthetic construct
  source 1..16: mol_type = other DNA
cggctggatatactgt

SEQ ID NO: 17 - DNA, 16 bp, synthetic construct
  source 1..16: mol_type = other DNA
aaatgtcttggtaatc

SEQ ID NO: 18 - DNA, 16 bp, synthetic construct
  source 1..16: mol_type = other DNA
aagtgcttttgtgatc

SEQ ID NO: 19 - DNA, 16 bp, synthetic construct
  source 1..16: mol_type = other DNA
ccactgtgacgatgtg

SEQ ID NO: 20 - DNA, 16 bp, synthetic construct
  source 1..16: mol_type = other DNA
gctggaacaatatggg

SEQ ID NO: 21 - DNA, 16 bp, synthetic construct
  source 1..16: mol_type = other DNA
cccaaggcctgaagtt

SEQ ID NO: 22 - DNA, 16 bp, synthetic construct
  source 1..16: mol_type = other DNA
atacaggccataatct

SEQ ID NO: 23 - DNA, 16 bp, synthetic construct
  source 1..16: mol_type = other DNA
atcagacttcttacga

SEQ ID NO: 24 - DNA, 16 bp, synthetic construct
  source 1..16: mol_type = other DNA
attgatatacgatgga

SEQ ID NO: 25 - DNA, 16 bp, synthetic construct
  source 1..16: mol_type = other DNA
ttctgcatacgattta

SEQ ID NO: 26 - DNA, 16 bp, synthetic construct
  source 1..16: mol_type = other DNA
tctggctggagcttat

SEQ ID NO: 27 - DNA, 16 bp, synthetic construct
  source 1..16: mol_type = other DNA
cattgattcgaaacta

SEQ ID NO: 28 - DNA, 16 bp, synthetic construct
  source 1..16: mol_type = other DNA
ttgactgctgctagtg

SEQ ID NO: 29 - DNA, 16 bp, synthetic construct
  source 1..16: mol_type = other DNA
ggtagcttttgtccac

SEQ ID NO: 30 - DNA, 16 bp, synthetic construct
  source 1..16: mol_type = other DNA
cagtcttaaaccttcc

SEQ ID NO: 31 - DNA, 16 bp, synthetic construct
  source 1..16: mol_type = other DNA
tggctacagattggaa

SEQ ID NO: 32 - DNA, 16 bp, synthetic construct
  source 1..16: mol_type = other DNA
ttagctgtgcactcat

SEQ ID NO: 33 - DNA, 16 bp, synthetic construct
  source 1..16: mol_type = other DNA
ccaggttgagataaag

SEQ ID NO: 34 - DNA, 16 bp, synthetic construct
  source 1..16: mol_type = other DNA
agagttgcaccgtttt

SEQ ID NO: 35 - DNA, 16 bp, synthetic construct
  source 1..16: mol_type = other DNA
cacttttggtggactt

SEQ ID NO: 36 - DNA, 16 bp, synthetic construct
  source 1..16: mol_type = other DNA
cggtcacctttcataa

SEQ ID NO: 37 - DNA, 16 bp, synthetic construct
  source 1..16: mol_type = other DNA
atctctgggaccaagg

SEQ ID NO: 38 - DNA, 16 bp, synthetic construct
  source 1..16: mol_type = other DNA
gtacagttccttttcc

SEQ ID NO: 39 - DNA, 16 bp, synthetic construct
  source 1..16: mol_type = other DNA
atagccagtacagttc

SEQ ID NO: 40 - DNA, 16 bp, synthetic construct
  source 1..16: mol_type = other DNA
ggagtcggattatttt

SEQ ID NO: 41 - DNA, 16 bp, synthetic construct
  source 1..16: mol_type = other DNA
gtccatgcaaaagcat

SEQ ID NO: 42 - DNA, 16 bp, synthetic construct
  source 1..16: mol_type = other DNA
aatacatatcttactc

SEQ ID NO: 43 - DNA, 16 bp, synthetic construct
  source 1..16: mol_type = other DNA
gtcataaaaatcgctg

SEQ ID NO: 44 - DNA, 16 bp, synthetic construct
  source 1..16: mol_type = other DNA
gaaaagcctgactcac

SEQ ID NO: 45 - DNA, 16 bp, synthetic construct
  source 1..16: mol_type = other DNA
catcaagcccttttca

SEQ ID NO: 46 - DNA, 16 bp, synthetic construct
  source 1..16: mol_type = other DNA
ctaaaggagatctgag

SEQ ID NO: 47 - DNA, 16 bp, synthetic construct
  source 1..16: mol_type = other DNA
tagcttaaactccaat

SEQ ID NO: 48 - DNA, 16 bp, synthetic construct
  source 1..16: mol_type = other DNA
ataagttaccagagca

SEQ ID NO: 49 - DNA, 16 bp, synthetic construct
  source 1..16: mol_type = other DNA
ctcaaagtcagtatcc

SEQ ID NO: 50 - DNA, 16 bp, synthetic construct
  source 1..16: mol_type = other DNA
ggcaaggatacctgaa

SEQ ID NO: 51 - DNA, 16 bp, synthetic construct
  source 1..16: mol_type = other DNA
ctcatttatgtaccaa

SEQ ID NO: 52 - DNA, 16 bp, synthetic construct
  source 1..16: mol_type = other DNA
tatgtaataggcagta

SEQ ID NO: 53 - DNA, 16 bp, synthetic construct
  source 1..16: mol_type = other DNA
gacaattaacattcgg

SEQ ID NO: 54 - DNA, 16 bp, synthetic construct
  source 1..16: mol_type = other DNA
ctaggaagtgatccat

SEQ ID NO: 55 - DNA, 16 bp, synthetic construct
  source 1..16: mol_type = other DNA
ctaataactacatgac

SEQ ID NO: 56 - DNA, 16 bp, synthetic construct
  source 1..16: mol_type = other DNA
tccaaagatgagagtc

SEQ ID NO: 57 - DNA, 16 bp, synthetic construct
  source 1..16: mol_type = other DNA
gcaaagatctggccag

SEQ ID NO: 58 - DNA, 16 bp, synthetic construct
  source 1..16: mol_type = other DNA
tccaaaagtgtcctcg

SEQ ID NO: 59 - DNA, 16 bp, synthetic construct
  source 1..16: mol_type = other DNA
ctacactaatattgag

SEQ ID NO: 60 - DNA, 16 bp, synthetic construct
  source 1..16: mol_type = other DNA
agtgaacatacattgt

SEQ ID NO: 61 - DNA, 16 bp, synthetic construct
  source 1..16: mol_type = other DNA
attaagacagttgagt

SEQ ID NO: 62 - DNA, 16 bp, synthetic construct
  source 1..16: mol_type = other DNA
atttattggtatggta

SEQ ID NO: 63 - DNA, 16 bp, synthetic construct
  source 1..16: mol_type = other DNA
ctgtaattggctcttg

SEQ ID NO: 64 - DNA, 16 bp, synthetic construct
  source 1..16: mol_type = other DNA
tcttatcttgggcacc

SEQ ID NO: 65 - DNA, 16 bp, synthetic construct
  source 1..16: mol_type = other DNA
tccattgaatcttcaa

SEQ ID NO: 66 - DNA, 16 bp, synthetic construct
  source 1..16: mol_type = other DNA
gaaaccaatcctcagc

SEQ ID NO: 67 - DNA, 16 bp, synthetic construct
  source 1..16: mol_type = other DNA
tggtaacggtgatcaa

SEQ ID NO: 68 - DNA, 16 bp, synthetic construct
  source 1..16: mol_type = other DNA
ttaagcagatggctta

SEQ ID NO: 69 - DNA, 16 bp, synthetic construct
  source 1..16: mol_type = other DNA
acagagaattgtttag

SEQ ID NO: 70 - DNA, 16 bp, synthetic construct
  source 1..16: mol_type = other DNA
agacaatacaggatag

SEQ ID NO: 71 - DNA, 16 bp, synthetic construct
  source 1..16: mol_type = other DNA
ccttaggaaagctcat

SEQ ID NO: 72 - DNA, 16 bp, synthetic construct
  source 1..16: mol_type = other DNA
atcaatgccttagccc

SEQ ID NO: 73 - DNA, 16 bp, synthetic construct
  source 1..16: mol_type = other DNA
tattatgtgattgagt

SEQ ID NO: 74 - DNA, 16 bp, synthetic construct
  source 1..16: mol_type = other DNA
attcataaacataggc

SEQ ID NO: 75 - DNA, 16 bp, synthetic construct
  source 1..16: mol_type = other DNA
actctaaatacccttg

SEQ ID NO: 76 - DNA, 16 bp, synthetic construct
  source 1..16: mol_type = other DNA
ggattaatcatgggac

SEQ ID NO: 77 - DNA, 16 bp, synthetic construct
  source 1..16: mol_type = other DNA
tcatagctcacttagt

SEQ ID NO: 78 - DNA, 16 bp, synthetic construct
  source 1..16: mol_type = other DNA
tttagtatttgggtgt

SEQ ID NO: 79 - DNA, 16 bp, synthetic construct
  source 1..16: mol_type = other DNA
caattgctctatagat

SEQ ID NO: 80 - DNA, 16 bp, synthetic construct
  source 1..16: mol_type = other DNA
agcatattcatttggc

SEQ ID NO: 81 - DNA, 16 bp, synthetic construct
  source 1..16: mol_type = other DNA
agtttatatggatttg

SEQ ID NO: 82 - DNA, 16 bp, synthetic construct
  source 1..16: mol_type = other DNA
ctagtaattgcatctg

SEQ ID NO: 83 - DNA, 16 bp, synthetic construct
  source 1..16: mol_type = other DNA
ctgggatagtggagga

SEQ ID NO: 84 - DNA, 16 bp, synthetic construct
  source 1..16: mol_type = other DNA
gctaaaagctcaccaa

SEQ ID NO: 85 - DNA, 16 bp, synthetic construct
  source 1..16: mol_type = other DNA
gatacccaggttgctt

SEQ ID NO: 86 - DNA, 16 bp, synthetic construct
  source 1..16: mol_type = other DNA
attagaagtcagccca

SEQ ID NO: 87 - DNA, 16 bp, synthetic construct
  source 1..16: mol_type = other DNA
gctatagtaattgcta

SEQ ID NO: 88 - DNA, 16 bp, synthetic construct
  source 1..16: mol_type = other DNA
gggaggaggtactgtc

SEQ ID NO: 89 - DNA, 16 bp, synthetic construct
  source 1..16: mol_type = other DNA
atgatgttcatggctt

SEQ ID NO: 90 - DNA, 16 bp, synthetic construct
  source 1..16: mol_type = other DNA
gactccaagtaggagt

SEQ ID NO: 91 - DNA, 16 bp, synthetic construct
  source 1..16: mol_type = other DNA
agctccagtaatgaga

SEQ ID NO: 92 - DNA, 16 bp, synthetic construct
  source 1..16: mol_type = other DNA
gcgcttattaatatcc

SEQ ID NO: 93 - DNA, 16 bp, synthetic construct
  source 1..16: mol_type = other DNA
ctagttttcggcactc

SEQ ID NO: 94 - DNA, 16 bp, synthetic construct
  source 1..16: mol_type = other DNA
gagagcgatagatctc

SEQ ID NO: 95 - DNA, 16 bp, synthetic construct
  source 1..16: mol_type = other DNA
accacgattgttacat

SEQ ID NO: 96 - DNA, 16 bp, synthetic construct
  source 1..16: mol_type = other DNA
tcggctggatatactg

SEQ ID NO: 97 - DNA, 16 bp, synthetic construct
  source 1..16: mol_type = other DNA
ctcaaatgtcttggta

SEQ ID NO: 98 - DNA, 16 bp, synthetic construct
  source 1..16: mol_type = other DNA
gaagtgcttttgtgat

SEQ ID NO: 99 - DNA, 16 bp, synthetic construct
  source 1..16: mol_type = other DNA
gccactgtgacgatgt

SEQ ID NO: 100 - DNA, 16 bp, synthetic construct
  source 1..16: mol_type = other DNA
tgctggaacaatatgg

SEQ ID NO: 101 - DNA, 16 bp, synthetic construct
  source 1..16: mol_type = other DNA
tcccaaggcctgaagt

SEQ ID NO: 102 - DNA, 16 bp, synthetic construct
  source 1..16: mol_type = other DNA
aatacaggccataatc

SEQ ID NO: 103 - DNA, 16 bp, synthetic construct
  source 1..16: mol_type = other DNA
tatcagacttcttacg

SEQ ID NO: 104 - DNA, 16 bp, synthetic construct
  source 1..16: mol_type = other DNA
tattgatatacgatgg

SEQ ID NO: 105 - DNA, 16 bp, synthetic construct
  source 1..16: mol_type = other DNA
attctgcatacgattt

SEQ ID NO: 106 - DNA, 16 bp, synthetic construct
  source 1..16: mol_type = other DNA
ctctggctggagctta

SEQ ID NO: 107 - DNA, 16 bp, synthetic construct
  source 1..16: mol_type = other DNA
gcattgattcgaaact

SEQ ID NO: 108 - DNA, 16 bp, synthetic construct
  source 1..16: mol_type = other DNA
tttgactgctgctagt

SEQ ID NO: 109 - DNA, 16 bp, synthetic construct
  source 1..16: mol_type = other DNA
aggtagcttttgtcca

SEQ ID NO: 110 - DNA, 16 bp, synthetic construct
  source 1..16: mol_type = other DNA
acagtcttaaaccttc

SEQ ID NO: 111 - DNA, 16 bp, synthetic construct
  source 1..16: mol_type = other DNA
atggctacagattgga

SEQ ID NO: 112 - DNA, 16 bp, synthetic construct
  source 1..16: mol_type = other DNA
cttagctgtgcactca

SEQ ID NO: 113 - DNA, 16 bp, synthetic construct
  source 1..16: mol_type = other DNA
gtccaggttgagataa

SEQ ID NO: 114 - DNA, 16 bp, synthetic construct
  source 1..16: mol_type = other DNA
tagagttgcaccgttt

SEQ ID NO: 115 - DNA, 16 bp, synthetic construct
  source 1..16: mol_type = other DNA
ccacttttggtggact

SEQ ID NO: 116 - DNA, 16 bp, synthetic construct
  source 1..16: mol_type = other DNA
tcggtcacctttcata

SEQ ID NO: 117 - DNA, 16 bp, synthetic construct
  source 1..16: mol_type = other DNA
catctctgggaccaag

SEQ ID NO: 118 - DNA, 16 bp, synthetic construct
  source 1..16: mol_type = other DNA
aatagccagtacagtt

SEQ ID NO: 119 - DNA, 16 bp, synthetic construct
  source 1..16: mol_type = other DNA
gggagtcggattattt

SEQ ID NO: 120 - DNA, 16 bp, synthetic construct
  source 1..16: mol_type = other DNA
agtccatgcaaaagca

SEQ ID NO: 121 - DNA, 16 bp, synthetic construct
  source 1..16: mol_type = other DNA
agtagatggtaagtca

SEQ ID NO: 122 - DNA, 16 bp, synthetic construct
  source 1..16: mol_type = other DNA
tgtcataaaaatcgct

SEQ ID NO: 123 - DNA, 16 bp, synthetic construct
  source 1..16: mol_type = other DNA
tactaatgtccaagga

SEQ ID NO: 124 - DNA, 16 bp, synthetic construct
  source 1..16: mol_type = other DNA
aaggttagatttcatc

SEQ ID NO: 125 - DNA, 16 bp, synthetic construct
  source 1..16: mol_type = other DNA
cctaaaggagatctga

SEQ ID NO: 126 - DNA, 16 bp, synthetic construct
  source 1..16: mol_type = other DNA
ctttagcttaaactcc

SEQ ID NO: 127 - DNA, 16 bp, synthetic construct
  source 1..16: mol_type = other DNA
gatgttaggacccagt

SEQ ID NO: 128 - DNA, 16 bp, synthetic construct
  source 1..16: mol_type = other DNA
aggcaaggatacctga

SEQ ID NO: 129 - DNA, 16 bp, synthetic construct
  source 1..16: mol_type = other DNA
ggagatataacattac

SEQ ID NO: 130 - DNA, 16 bp, synthetic construct
  source 1..16: mol_type = other DNA
ctatgtaataggcagt

SEQ ID NO: 131 - DNA, 16 bp, synthetic construct
  source 1..16: mol_type = other DNA
agacaattaacattcg

SEQ ID NO: 132 - DNA, 16 bp, synthetic construct
  source 1..16: mol_type = other DNA
actaggaagtgatcca

SEQ ID NO: 133 - DNA, 16 bp, synthetic construct
  source 1..16: mol_type = other DNA
cctaataactacatga

SEQ ID NO: 134 - DNA, 16 bp, synthetic construct
  source 1..16: mol_type = other DNA
atccaaagatgagagt

SEQ ID NO: 135 - DNA, 16 bp, synthetic construct
  source 1..16: mol_type = other DNA
ggcaaagatctggcca

SEQ ID NO: 136 - DNA, 16 bp, synthetic construct
  source 1..16: mol_type = other DNA
gtccaaaagtgtcctc

SEQ ID NO: 137 - DNA, 16 bp, synthetic construct
  source 1..16: mol_type = other DNA
cctagattctacacta

SEQ ID NO: 138 - DNA, 16 bp, synthetic construct
  source 1..16: mol_type = other DNA
gatagtgaacatacat

SEQ ID NO: 139 - DNA, 16 bp, synthetic construct
  source 1..16: mol_type = other DNA
gtattaagacagttga

SEQ ID NO: 140 - DNA, 16 bp, synthetic construct
  source 1..16: mol_type = other DNA
aatttattggtatggt

SEQ ID NO: 141 - DNA, 16 bp, synthetic construct
  source 1..16: mol_type = other DNA
gtaaacgactctgtaa

SEQ ID NO: 142 - DNA, 16 bp, synthetic construct
  source 1..16: mol_type = other DNA
gcacaagcacactgta

SEQ ID NO: 143 - DNA, 16 bp, synthetic construct
  source 1..16: mol_type = other DNA
ctacatgtaaggtttt

SEQ ID NO: 144 - DNA, 16 bp, synthetic construct
  source 1..16: mol_type = other DNA
tagctaagggagagtg

SEQ ID NO: 145 - DNA, 16 bp, synthetic construct
  source 1..16: mol_type = other DNA
agacagggtggtaacg

SEQ ID NO: 146 - DNA, 16 bp, synthetic construct
  source 1..16: mol_type = other DNA
gttaagcagatggctt

SEQ ID NO: 147 - DNA, 16 bp, synthetic construct
  source 1..16: mol_type = other DNA
ctcaacagagaattgt

SEQ ID NO: 148 - DNA, 16 bp, synthetic construct
  source 1..16: mol_type = other DNA
gctttgaagacaatac

SEQ ID NO: 149 - DNA, 16 bp, synthetic construct
  source 1..16: mol_type = other DNA
cccttaggaaagctca

SEQ ID NO: 150 - DNA, 16 bp, synthetic construct
  source 1..16: mol_type = other DNA
tatcaatgccttagcc

SEQ ID NO: 151 - DNA, 16 bp, synthetic construct
  source 1..16: mol_type = other DNA
ttattatgtgattgag

SEQ ID NO: 152 - DNA, 16 bp, synthetic construct
  source 1..16: mol_type = other DNA
actgaaggctgtgtac

SEQ ID NO: 153 - DNA, 16 bp, synthetic construct
  source 1..16: mol_type = other DNA
aactctaaataccctt

SEQ ID NO: 154 - DNA, 16 bp, synthetic construct
  source 1..16: mol_type = other DNA
aggattaatcatggga

SEQ ID NO: 155 - DNA, 16 bp, synthetic construct
  source 1..16: mol_type = other DNA
tttcatagctcactta

SEQ ID NO: 156 - DNA, 16 bp, synthetic construct
  source 1..16: mol_type = other DNA
ctctattggtgtttta

SEQ ID NO: 157 - DNA, 16 bp, synthetic construct
  source 1..16: mol_type = other DNA
aatactccccaattgc

SEQ ID NO: 158 - DNA, 16 bp, synthetic construct
  source 1..16: mol_type = other DNA
agaagatattatcagc

SEQ ID NO: 159 - DNA, 16 bp, synthetic construct
  source 1..16: mol_type = other DNA
caccaatgcagtttgt

SEQ ID NO: 160 - DNA, 16 bp, synthetic construct
  source 1..16: mol_type = other DNA
gctagtaattgcatct

SEQ ID NO: 161 - DNA, 16 bp, synthetic construct
  source 1..16: mol_type = other DNA
gctataactggaagga

SEQ ID NO: 162 - DNA, 16 bp, synthetic construct
  source 1..16: mol_type = other DNA
tgctaaaagctcacca

SEQ ID NO: 163 - DNA, 16 bp, synthetic construct
  source 1..16: mol_type = other DNA
ttaagatacccaggtt

SEQ ID NO: 164 - DNA, 16 bp, synthetic construct
  source 1..16: mol_type = other DNA
tattagaagtcagccc

SEQ ID NO: 165 - DNA, 16 bp, synthetic construct
  source 1..16: mol_type = other DNA
ggctatagtaattgct

SEQ ID NO: 166 - DNA, 16 bp, synthetic construct
  source 1..16: mol_type = other DNA
ctagggaggaggtact

SEQ ID NO: 167 - DNA, 16 bp, synthetic construct
  source 1..16: mol_type = other DNA
gatgatgttcatggct

SEQ ID NO: 168 - DNA, 16 bp, synthetic construct
  source 1..16: mol_type = other DNA
cgactccaagtaggag

SEQ ID NO: 169 - DNA, 16 bp, synthetic construct
  source 1..16: mol_type = other DNA
cctgcctattccatgc

SEQ ID NO: 170 - DNA, 16 bp, synthetic construct
  source 1..16: mol_type = other DNA
cgcgcttattaatatc

SEQ ID NO: 171 - DNA, 16 bp, synthetic construct
  source 1..16: mol_type = other DNA
cctagttttcggcact

SEQ ID NO: 172 - DNA, 16 bp, synthetic construct
  source 1..16: mol_type = other DNA
agagagcgatagatct

SEQ ID NO: 173 - DNA, 16 bp, synthetic construct
  source 1..16: mol_type = other DNA
caccacgattgttaca

SEQ ID NO: 174 - DNA, 16 bp, synthetic construct
  source 1..16: mol_type = other DNA
atcggctggatatact

SEQ ID NO: 175 - DNA, 16 bp, synthetic construct
  source 1..16: mol_type = other DNA
cctcaaatgtcttggt

SEQ ID NO: 176 - DNA, 16 bp, synthetic construct
  source 1..16: mol_type = other DNA
cgatggaagaagtgct

SEQ ID NO: 177 - DNA, 16 bp, synthetic construct
  source 1..16: mol_type = other DNA
agccactgtgacgatg

SEQ ID NO: 178 - DNA, 16 bp, synthetic construct
  source 1..16: mol_type = other DNA
ttgctggaacaatatg

SEQ ID NO: 179 - DNA, 16 bp, synthetic construct
  source 1..16: mol_type = other DNA
gttttgataccagttt

SEQ ID NO: 180 - DNA, 16 bp, synthetic construct
  source 1..16: mol_type = other DNA
caatacaggccataat

SEQ ID NO: 181 - DNA, 16 bp, synthetic construct
  source 1..16: mol_type = other DNA
ctatcagacttcttac

SEQ ID NO: 182 - DNA, 16 bp, synthetic construct
  source 1..16: mol_type = other DNA
atattgatatacgatg

SEQ ID NO: 183 - DNA, 16 bp, synthetic construct
  source 1..16: mol_type = other DNA
tattctgcatacgatt

SEQ ID NO: 184 - DNA, 16 bp, synthetic construct
  source 1..16: mol_type = other DNA
tctctggctggagctt

SEQ ID NO: 185 - DNA, 16 bp, synthetic construct
  source 1..16: mol_type = other DNA
agcattgattcgaaac

SEQ ID NO: 186 - DNA, 16 bp, synthetic construct
  source 1..16: mol_type = other DNA
gtttgactgctgctag

SEQ ID NO: 187 - DNA, 16 bp, synthetic construct
  source 1..16: mol_type = other DNA
gaggtagcttttgtcc

SEQ ID NO: 188 - DNA, 16 bp, synthetic construct
  source 1..16: mol_type = other DNA
aacagtcttaaacctt

SEQ ID NO: 189 - DNA, 16 bp, synthetic construct
  source 1..16: mol_type = other DNA
catggctacagattgg

SEQ ID NO: 190 - DNA, 16 bp, synthetic construct
  source 1..16: mol_type = other DNA
tcttagctgtgcactc

SEQ ID NO: 191 - DNA, 16 bp, synthetic construct
  source 1..16: mol_type = other DNA
tgtccaggttgagata

SEQ ID NO: 192 - DNA, 16 bp, synthetic construct
  source 1..16: mol_type = other DNA
atagagttgcaccgtt

SEQ ID NO: 193 - DNA, 16 bp, synthetic construct
  source 1..16: mol_type = other DNA
tccacttttggtggac

SEQ ID NO: 194 - DNA, 16 bp, synthetic construct
  source 1..16: mol_type = other DNA
gtcggtcacctttcat

SEQ ID NO: 195 - DNA, 16 bp, synthetic construct
  source 1..16: mol_type = other DNA
acatctctgggaccaa

SEQ ID NO: 196 - DNA, 16 bp, synthetic construct
  source 1..16: mol_type = other DNA
taatagccagtacagt

SEQ ID NO: 197 - DNA, 16 bp, synthetic construct
  source 1..16: mol_type = other DNA
tgggagtcggattatt

SEQ ID NO: 198 - DNA, 16 bp, synthetic construct
  source 1..16: mol_type = other DNA
tagtccatgcaaaagc

SEQ ID NO: 199 - DNA, 16 bp, synthetic construct
  source 1..16: mol_type = other DNA
aagtagatggtaagtc

SEQ ID NO: 200 - DNA, 16 bp, synthetic construct
  source 1..16: mol_type = other DNA
atgtcataaaaatcgc

SEQ ID NO: 201 - DNA, 16 bp, synthetic construct
  source 1..16: mol_type = other DNA
atactaatgtccaagg

SEQ ID NO: 202 - DNA, 16 bp, synthetic construct
  source 1..16: mol_type = other DNA
gatttgaaggttagat

SEQ ID NO: 203 - DNA, 16 bp, synthetic construct
  source 1..16: mol_type = other DNA
gcctaaaggagatctg

SEQ ID NO: 204 - DNA, 16 bp, synthetic construct
  source 1..16: mol_type = other DNA
tagcaaaacacttgct

SEQ ID NO: 205 - DNA, 16 bp, synthetic construct
  source 1..16: mol_type = other DNA
ggatgttaggacccag

SEQ ID NO: 206 - DNA, 16 bp, synthetic construct
  source 1..16: mol_type = other DNA
atacttttccgtctca

SEQ ID NO: 207 - DNA, 16 bp, synthetic construct
  source 1..16: mol_type = other DNA
ctctaggagatataac

SEQ ID NO: 208 - DNA, 16 bp, synthetic construct
  source 1..16: mol_type = other DNA
actatgtaataggcag

SEQ ID NO: 209 - DNA, 16 bp, synthetic construct
  source 1..16: mol_type = other DNA
aaatttgtgaacctgc

SEQ ID NO: 210 - DNA, 16 bp, synthetic construct
  source 1..16: mol_type = other DNA
aactaggaagtgatcc

SEQ ID NO: 211 - DNA, 16 bp, synthetic construct
  source 1..16: mol_type = other DNA
acctaataactacatg

SEQ ID NO: 212 - DNA, 16 bp, synthetic construct
  source 1..16: mol_type = other DNA
ccaatataatccaaag

SEQ ID NO: 213 - DNA, 16 bp, synthetic construct
  source 1..16: mol_type = other DNA
taaggcaaagatctgg

SEQ ID NO: 214 - DNA, 16 bp, synthetic construct
  source 1..16: mol_type = other DNA
cgtccaaaagtgtcct

SEQ ID NO: 215 - DNA, 16 bp, synthetic construct
  source 1..16: mol_type = other DNA
ccctagattctacact

SEQ ID NO: 216 - DNA, 16 bp, synthetic construct
  source 1..16: mol_type = other DNA
ggatagtgaacataca

SEQ ID NO: 217 - DNA, 16 bp, synthetic construct
  source 1..16: mol_type = other DNA
tgtattaagacagttg

SEQ ID NO: 218 - DNA, 16 bp, synthetic construct
  source 1..16: mol_type = other DNA
ccaaatcaggtagttt

SEQ ID NO: 219 - DNA, 16 bp, synthetic construct
  source 1..16: mol_type = other DNA
agtaaacgactctgta

SEQ ID NO: 220 - DNA, 16 bp, synthetic construct
  source 1..16: mol_type = other DNA
ttttagtcaggtagag

SEQ ID NO: 221 - DNA, 16 bp, synthetic construct
  source 1..16: mol_type = other DNA
atcctacatgtaaggt

SEQ ID NO: 222 - DNA, 16 bp, synthetic construct
  source 1..16: mol_type = other DNA
gttagctaagggagag

SEQ ID NO: 223 - DNA, 16 bp, synthetic construct
  source 1..16: mol_type = other DNA
ttaaagacagggtggt

SEQ ID NO: 224 - DNA, 16 bp, synthetic construct
  source 1..16: mol_type = other DNA
tgttaagcagatggct

SEQ ID NO: 225 - DNA, 16 bp, synthetic construct
  source 1..16: mol_type = other DNA
aatgaggcggcactca

SEQ ID NO: 226 - DNA, 16 bp, synthetic construct
  source 1..16: mol_type = other DNA
tgacaatgtgcagctc

SEQ ID NO: 227 - DNA, 16 bp, synthetic construct
  source 1..16: mol_type = other DNA
acccttaggaaagctc

SEQ ID NO: 228 - DNA, 16 bp, synthetic construct
  source 1..16: mol_type = other DNA
atatcaatgccttagc

SEQ ID NO: 229 - DNA, 16 bp, synthetic construct
  source 1..16: mol_type = other DNA
gattattatgtgattg

SEQ ID NO: 230 - DNA, 16 bp, synthetic construct
  source 1..16: mol_type = other DNA
tatactgaaggctgtg

SEQ ID NO: 231 - DNA, 16 bp, synthetic construct
  source 1..16: mol_type = other DNA
gaattgctcacccttt

SEQ ID NO: 232 - DNA, 16 bp, synthetic construct
  source 1..16: mol_type = other DNA
taggattaatcatggg

SEQ ID NO: 233 - DNA, 16 bp, synthetic construct
  source 1..16: mol_type = other DNA
cagtaggtgtgtttca

SEQ ID NO: 234 - DNA, 16 bp, synthetic construct
  source 1..16: mol_type = other DNA
aaaaagctctattggt

SEQ ID NO: 235 - DNA, 16 bp, synthetic construct
  source 1..16: mol_type = other DNA
gatatgtcaatactcc

SEQ ID NO: 236 - DNA, 16 bp, synthetic construct
  source 1..16: mol_type = other DNA
catttgaagtctatac

SEQ ID NO: 237 - DNA, 16 bp, synthetic construct
  source 1..16: mol_type = other DNA
gatacaccaatgcagt

SEQ ID NO: 238 - DNA, 16 bp, synthetic construct
  source 1..16: mol_type = other DNA
tgctagtaattgcatc

SEQ ID NO: 239 - DNA, 16 bp, synthetic construct
  source 1..16: mol_type = other DNA
ggctataactggaagg

SEQ ID NO: 240 - DNA, 16 bp, synthetic construct
  source 1..16: mol_type = other DNA
atgctaaaagctcacc

SEQ ID NO: 241 - DNA, 16 bp, synthetic construct
  source 1..16: mol_type = other DNA
cttaagatacccaggt

SEQ ID NO: 242 - DNA, 16 bp, synthetic construct
  source 1..16: mol_type = other DNA
ttattagaagtcagcc

SEQ ID NO: 243 - DNA, 16 bp, synthetic construct
  source 1..16: mol_type = other DNA
tggctatagtaattgc

SEQ ID NO: 244 - DNA, 16 bp, synthetic construct
  source 1..16: mol_type = other DNA
cctagggaggaggtac

SEQ ID NO: 245 - DNA, 16 bp, synthetic construct
  source 1..16: mol_type = other DNA
ggatgatgttcatggc

SEQ ID NO: 246 - DNA, 16 bp, synthetic construct
  source 1..16: mol_type = other DNA
acgactccaagtagga

SEQ ID NO: 247 - DNA, 16 bp, synthetic construct
  source 1..16: mol_type = other DNA
tgcctgcctattccat

SEQ ID NO: 248 - DNA, 16 bp, synthetic construct
  source 1..16: mol_type = other DNA
ccgcgcttattaatat

SEQ ID NO: 249 - DNA, 16 bp, synthetic construct
  source 1..16: mol_type = other DNA
gcctagttttcggcac

SEQ ID NO: 250 - DNA, 16 bp, synthetic construct
  source 1..16: mol_type = other DNA
tagagagcgatagatc

SEQ ID NO: 251 - DNA, 16 bp, synthetic construct
  source 1..16: mol_type = other DNA
tcaccacgattgttac

SEQ ID NO: 252 - DNA, 16 bp, synthetic construct
  source 1..16: mol_type = other DNA
gatcggctggatatac

SEQ ID NO: 253 - DNA, 16 bp, synthetic construct
  source 1..16: mol_type = other DNA
acctcaaatgtcttgg

SEQ ID NO: 254 - DNA, 16 bp, synthetic construct
  source 1..16: mol_type = other DNA
tcgatggaagaagtgc

SEQ ID NO: 255 - DNA, 16 bp, synthetic construct
  source 1..16: mol_type = other DNA
tgaagccactgtgacg

SEQ ID NO: 256 - DNA, 16 bp, synthetic construct
  source 1..16: mol_type = other DNA
ggcaaatttgctggaa

SEQ ID NO: 257 - DNA, 16 bp, synthetic construct
  source 1..16: mol_type = other DNA
ggttttgataccagtt

SEQ ID NO: 258 - DNA, 16 bp, synthetic construct
  source 1..16: mol_type = other DNA
ccaatacaggccataa

SEQ ID NO: 259 - DNA, 16 bp, synthetic construct
  source 1..16: mol_type = other DNA
tctatcagacttctta

SEQ ID NO: 260 - DNA, 16 bp, synthetic construct
  source 1..16: mol_type = other DNA
gatattgatatacgat

SEQ ID NO: 261 - DNA, 16 bp, synthetic construct
  source 1..16: mol_type = other DNA
atattctgcatacgat

SEQ ID NO: 262 - DNA, 16 bp, synthetic construct
  source 1..16: mol_type = other DNA
catctctggctggagc

SEQ ID NO: 263 - DNA, 16 bp, synthetic construct
  source 1..16: mol_type = other DNA
cagcattgattcgaaa

SEQ ID NO: 264 - DNA, 16 bp, synthetic construct
  source 1..16: mol_type = other DNA
cgtttgactgctgcta

SEQ ID NO: 265 - DNA, 16 bp, synthetic construct
  source 1..16: mol_type = other DNA
ggaggtagcttttgtc

SEQ ID NO: 266 - DNA, 16 bp, synthetic construct
  source 1..16: mol_type = other DNA
gaacagtcttaaacct

SEQ ID NO: 267 - DNA, 16 bp, synthetic construct
  source 1..16: mol_type = other DNA
gcatggctacagattg

SEQ ID NO: 268 - DNA, 16 bp, synthetic construct
  source 1..16: mol_type = other DNA
ctcttagctgtgcact

SEQ ID NO: 269 - DNA, 16 bp, synthetic construct
  source 1..16: mol_type = other DNA
atgtccaggttgagat

SEQ ID NO: 270 - DNA, 16 bp, synthetic construct
  source 1..16: mol_type = other DNA
aatagagttgcaccgt

SEQ ID NO: 271 - DNA, 16 bp, synthetic construct
  source 1..16: mol_type = other DNA
gtccacttttggtgga

SEQ ID NO: 272 - DNA, 16 bp, synthetic construct
  source 1..16: mol_type = other DNA
agtcggtcacctttca

SEQ ID NO: 273 - DNA, 16 bp, synthetic construct
  source 1..16: mol_type = other DNA
aacatctctgggacca

SEQ ID NO: 274 - DNA, 16 bp, synthetic construct
  source 1..16: mol_type = other DNA
gtaatagccagtacag

SEQ ID NO: 275 - DNA, 16 bp, synthetic construct
  source 1..16: mol_type = other DNA
gtgggagtcggattat

SEQ ID NO: 276 - DNA, 16 bp, synthetic construct
  source 1..16: mol_type = other DNA
gaggatagtccatgca

SEQ ID NO: 277 - DNA, 16 bp, synthetic construct
  source 1..16: mol_type = other DNA
gataagtagatggtaa

SEQ ID NO: 278 - DNA, 16 bp, synthetic construct
  source 1..16: mol_type = other DNA
ttctatcaacctgcac

SEQ ID NO: 279 - DNA, 16 bp, synthetic construct
  source 1..16: mol_type = other DNA
aatactaatgtccaag

SEQ ID NO: 280 - DNA, 16 bp, synthetic construct
  source 1..16: mol_type = other DNA
atatagccctttcccc

SEQ ID NO: 281 - DNA, 16 bp, synthetic construct
  source 1..16: mol_type = other DNA
cgcctaaaggagatct

SEQ ID NO: 282 - DNA, 16 bp, synthetic construct
  source 1..16: mol_type = other DNA
gttagcaaaacacttg

SEQ ID NO: 283 - DNA, 16 bp, synthetic construct
  source 1..16: mol_type = other DNA
aaacatggatgttagg

SEQ ID NO: 284 - DNA, 16 bp, synthetic construct
  source 1..16: mol_type = other DNA
tatacttttccgtctc

SEQ ID NO: 285 - DNA, 16 bp, synthetic construct
  source 1..16: mol_type = other DNA
tactctaggagatata

SEQ ID NO: 286 - DNA, 16 bp, synthetic construct
  source 1..16: mol_type = other DNA
caactatgtaataggc

SEQ ID NO: 287 - DNA, 16 bp, synthetic construct
  source 1..16: mol_type = other DNA
aagaaatttgtgaacc

SEQ ID NO: 288 - DNA, 16 bp, synthetic construct
  source 1..16: mol_type = other DNA
agttaataggactaaa

SEQ ID NO: 289 - DNA, 16 bp, synthetic construct
  source 1..16: mol_type = other DNA
aacctaataactacat

SEQ ID NO: 290 - DNA, 16 bp, synthetic construct
  source 1..16: mol_type = other DNA
gaccaatataatccaa

SEQ ID NO: 291 - DNA, 16 bp, synthetic construct
  source 1..16: mol_type = other DNA
gattaaggcaaagatc

SEQ ID NO: 292 - DNA, 16 bp, synthetic construct
  source 1..16: mol_type = other DNA
ctagaacacttgcctc

SEQ ID NO: 293 - DNA, 16 bp, synthetic construct
  source 1..16: mol_type = other DNA
gaatccagatctgccc

SEQ ID NO: 294 - DNA, 16 bp, synthetic construct
  source 1..16: mol_type = other DNA
gaggatagtgaacata

SEQ ID NO: 295 - DNA, 16 bp, synthetic construct
  source 1..16: mol_type = other DNA
ctgtattaagacagtt

SEQ ID NO: 296 - DNA, 16 bp, synthetic construct
  source 1..16: mol_type = other DNA
tccaaatcaggtagtt

SEQ ID NO: 297 - DNA, 16 bp, synthetic construct
  source 1..16: mol_type = other DNA
gagtaaacgactctgt

SEQ ID NO: 298 - DNA, 16 bp, synthetic construct
  source 1..16: mol_type = other DNA
cttttagtcaggtaga

SEQ ID NO: 299 - DNA, 16 bp, synthetic construct
  source 1..16: mol_type = other DNA
gcttaatgttcagttt

SEQ ID NO: 300 - DNA, 16 bp, synthetic construct
  source 1..16: mol_type = other DNA
aagcattgttagctaa

SEQ ID NO: 301 - DNA, 16 bp, synthetic construct
  source 1..16: mol_type = other DNA
atttatttgctggtcc

SEQ ID NO: 302 - DNA, 16 bp, synthetic construct
  source 1..16: mol_type = other DNA
tatactaggattagaa

SEQ ID NO: 303 - DNA, 16 bp, synthetic construct
  source 1..16: mol_type = other DNA
aaatgaggcggcactc

SEQ ID NO: 304 - DNA, 16 bp, synthetic construct
  source 1..16: mol_type = other DNA
aatgtaagaagccacg

SEQ ID NO: 305 - DNA, 16 bp, synthetic construct
  source 1..16: mol_type = other DNA
cccaagagtggcagga

SEQ ID NO: 306 - DNA, 16 bp, synthetic construct
  source 1..16: mol_type = other DNA
catatcaatgccttag

SEQ ID NO: 307 - DNA, 16 bp, synthetic construct
  source 1..16: mol_type = other DNA
gcagattattatgtga

SEQ ID NO: 308 - DNA, 16 bp, synthetic construct
  source 1..16: mol_type = other DNA
ttatactgaaggctgt

SEQ ID NO: 309 - DNA, 16 bp, synthetic construct
  source 1..16: mol_type = other DNA
atacattagcaagcta

SEQ ID NO: 310 - DNA, 16 bp, synthetic construct
  source 1..16: mol_type = other DNA
ctaggattaatcatgg

SEQ ID NO: 311 - DNA, 16 bp, synthetic construct
  source 1..16: mol_type = other DNA
tccagtaggtgtgttt

SEQ ID NO: 312 - DNA, 16 bp, synthetic construct
  source 1..16: mol_type = other DNA
ctctattgggccaggc

SEQ ID NO: 313 - DNA, 16 bp, synthetic construct
  source 1..16: mol_type = other DNA
gatattatgttcttgg

SEQ ID NO: 314 - DNA, 16 bp, synthetic construct
  source 1..16: mol_type = other DNA
ggaaattgttgctgtt

SEQ ID NO: 315 - DNA, 16 bp, synthetic construct
  source 1..16: mol_type = other DNA
gaaattgatacaccaa

SEQ ID NO: 316 - DNA, 16 bp, synthetic construct
  source 1..16: mol_type = other DNA
atgctagtaattgcat

SEQ ID NO: 317 - DNA, 16 bp, synthetic construct
  source 1..16: mol_type = other DNA
agaattaagggctata

SEQ ID NO: 318 - DNA, 16 bp, synthetic construct
  source 1..16: mol_type = other DNA
gatgctaaaagctcac

SEQ ID NO: 319 - DNA, 16 bp, synthetic construct
  source 1..16: mol_type = other DNA
tcttaagatacccagg

SEQ ID NO: 320 - DNA, 16 bp, synthetic construct
  source 1..16: mol_type = other DNA
gttattagaagtcagc

SEQ ID NO: 321 - DNA, 16 bp, synthetic construct
  source 1..16: mol_type = other DNA
aattatgccttgtggc

SEQ ID NO: 322 - DNA, 16 bp, synthetic construct
  source 1..16: mol_type = other DNA
tcctagggaggaggta

SEQ ID NO: 323 - DNA, 16 bp, synthetic construct
  source 1..16: mol_type = other DNA
aggatgatgttcatgg

SEQ ID NO: 324 - DNA, 16 bp, synthetic construct
  source 1..16: mol_type = other DNA
aacgactccaagtagg

SEQ ID NO: 325 - DNA, 16 bp, synthetic construct
  source 1..16: mol_type = other DNA
gtctgcctgcctattc

SEQ ID NO: 326 - DNA, 16 bp, synthetic construct
  source 1..16: mol_type = other DNA
accgcgcttattaata

SEQ ID NO: 327 - DNA, 16 bp, synthetic construct
  source 1..16: mol_type = other DNA
cgcctagttttcggca

SEQ ID NO: 328 - DNA, 16 bp, synthetic construct
  source 1..16: mol_type = other DNA
ttagagagcgatagat

SEQ ID NO: 329 - DNA, 16 bp, synthetic construct
  source 1..16: mol_type = other DNA
ttcaccacgattgtta

SEQ ID NO: 330 - DNA, 16 bp, synthetic construct
  source 1..16: mol_type = other DNA
agatcggctggatata

SEQ ID NO: 331 - DNA, 16 bp, synthetic construct
  source 1..16: mol_type = other DNA
gacctcaaatgtcttg

SEQ ID NO: 332 - DNA, 16 bp, synthetic construct
  source 1..16: mol_type = other DNA
atcgatggaagaagtg

SEQ ID NO: 333 - DNA, 16 bp, synthetic construct
  source 1..16: mol_type = other DNA
cgcacactgaagccac

SEQ ID NO: 334 - DNA, 16 bp, synthetic construct
  source 1..16: mol_type = other DNA
cggcaaatttgctgga

SEQ ID NO: 335 - DNA, 16 bp, synthetic construct
  source 1..16: mol_type = other DNA
aggttttgataccagt

SEQ ID NO: 336 - DNA, 16 bp, synthetic construct
  source 1..16: mol_type = other DNA
tccaatacaggccata

SEQ ID NO: 337 - DNA, 16 bp, synthetic construct
  source 1..16: mol_type = other DNA
catctatcagacttct

SEQ ID NO: 338 - DNA, 16 bp, synthetic construct
  source 1..16: mol_type = other DNA
agatattgatatacga

SEQ ID NO: 339 - DNA, 16 bp, synthetic construct
  source 1..16: mol_type = other DNA
aatattctgcatacga

SEQ ID NO: 340 - DNA, 16 bp, synthetic construct
  source 1..16: mol_type = other DNA
acatctctggctggag

SEQ ID NO: 341 - DNA, 16 bp, synthetic construct
  source 1..16: mol_type = other DNA
gcagcattgattcgaa

SEQ ID NO: 342 - DNA, 16 bp, synthetic construct
  source 1..16: mol_type = other DNA
taattaatcttgttcg

SEQ ID NO: 343 - DNA, 16 bp, synthetic construct
  source 1..16: mol_type = other DNA
gggaggtagcttttgt

SEQ ID NO: 344 - DNA, 16 bp, synthetic construct
  source 1..16: mol_type = other DNA
tgaacagtcttaaacc

SEQ ID NO: 345 - DNA, 16 bp, synthetic construct
  source 1..16: mol_type = other DNA
ggcatggctacagatt

SEQ ID NO: 346 - DNA, 16 bp, synthetic construct
  source 1..16: mol_type = other DNA
tctcttagctgtgcac

SEQ ID NO: 347 - DNA, 16 bp, synthetic construct
  source 1..16: mol_type = other DNA
tatgtccaggttgaga

SEQ ID NO: 348 - DNA, 16 bp, synthetic construct
  source 1..16: mol_type = other DNA
gaatagagttgcaccg

SEQ ID NO: 349 - DNA, 16 bp, synthetic construct
  source 1..16: mol_type = other DNA
ggtccacttttggtgg

SEQ ID NO: 350 - DNA, 16 bp, synthetic construct
  source 1..16: mol_type = other DNA
gagtcggtcacctttc

SEQ ID NO: 351 - DNA, 16 bp, synthetic construct
  source 1..16: mol_type = other DNA
taaacatctctgggac

SEQ ID NO: 352 - DNA, 16 bp, synthetic construct
  source 1..16: mol_type = other DNA
tgtaatagccagtaca

SEQ ID NO: 353 - DNA, 16 bp, synthetic construct
  source 1..16: mol_type = other DNA
agtgggagtcggatta

SEQ ID NO: 354 - DNA, 16 bp, synthetic construct
  source 1..16: mol_type = other DNA
agaggatagtccatgc

SEQ ID NO: 355 - DNA, 16 bp, synthetic construct
  source 1..16: mol_type = other DNA
aagataagtagatggt

SEQ ID NO: 356 - DNA, 16 bp, synthetic construct
  source 1..16: mol_type = other DNA
agcttggaaggagact

SEQ ID NO: 357 - DNA, 16 bp, synthetic construct
  source 1..16: mol_type = other DNA
gttaatgtagtgttta

SEQ ID NO: 358 - DNA, 16 bp, synthetic construct
  source 1..16: mol_type = other DNA
aatatagccctttccc

SEQ ID NO: 359 - DNA, 16 bp, synthetic construct
  source 1..16: mol_type = other DNA
tcgcctaaaggagatc

SEQ ID NO: 360 - DNA, 16 bp, synthetic construct
  source 1..16: mol_type = other DNA
tgcaaaatgtgatgcc

SEQ ID NO: 361 - DNA, 16 bp, synthetic construct
  source 1..16: mol_type = other DNA
caaacatggatgttag

SEQ ID NO: 362 - DNA, 16 bp, synthetic construct
  source 1..16: mol_type = other DNA
ttatacttttccgtct

SEQ ID NO: 363 - DNA, 16 bp, synthetic construct
  source 1..16: mol_type = other DNA
atagggagaccatgct

SEQ ID NO: 364 - DNA, 16 bp, synthetic construct
  source 1..16: mol_type = other DNA
aaaacattgctcttcg

SEQ ID NO: 365 - DNA, 16 bp, synthetic construct
  source 1..16: mol_type = other DNA
taaatcaggcagtcat

SEQ ID NO: 366 - DNA, 16 bp, synthetic construct
  source 1..16: mol_type = other DNA
aagttaataggactaa

SEQ ID NO: 367 - DNA, 16 bp, synthetic construct
  source 1..16: mol_type = other DNA
ataacctaataactac

SEQ ID NO: 368 - DNA, 16 bp, synthetic construct
  source 1..16: mol_type = other DNA
aagttttgggaccaat

SEQ ID NO: 369 - DNA, 16 bp, synthetic construct
  source 1..16: mol_type = other DNA
cttgattaaggcaaag

SEQ ID NO: 370 - DNA, 16 bp, synthetic construct
  source 1..16: mol_type = other DNA
atctagaacacttgcc

SEQ ID NO: 371 - DNA, 16 bp, synthetic construct
  source 1..16: mol_type = other DNA
ctggtaaaggtaaggg

SEQ ID NO: 372 - DNA, 16 bp, synthetic construct
  source 1..16: mol_type = other DNA
agaggatagtgaacat

SEQ ID NO: 373 - DNA, 16 bp, synthetic construct
  source 1..16: mol_type = other DNA
actgtattaagacagt

SEQ ID NO: 374 - DNA, 16 bp, synthetic construct
  source 1..16: mol_type = other DNA
ttccaaatcaggtagt

SEQ ID NO: 375 - DNA, 16 bp, synthetic construct
  source 1..16: mol_type = other DNA
tgagtaaacgactctg

SEQ ID NO: 376 - DNA, 16 bp, synthetic construct
  source 1..16: mol_type = other DNA
acttttagtcaggtag

SEQ ID NO: 377 - DNA, 16 bp, synthetic construct
  source 1..16: mol_type = other DNA
ggcttaatgttcagtt

SEQ ID NO: 378 - DNA, 16 bp, synthetic construct
  source 1..16: mol_type = other DNA
ttaagcattgttagct

SEQ ID NO: 379 - DNA, 16 bp, synthetic construct
  source 1..16: mol_type = other DNA
aatttatttgctggtc

SEQ ID NO: 380 - DNA, 16 bp, synthetic construct
  source 1..16: mol_type = other DNA
atatactaggattaga

SEQ ID NO: 381 - DNA, 16 bp, synthetic construct
  source 1..16: mol_type = other DNA
caaatgaggcggcact

SEQ ID NO: 382 - DNA, 16 bp, synthetic construct
  source 1..16: mol_type = other DNA
gcaaatgtaagaagcc

SEQ ID NO: 383 - DNA, 16 bp, synthetic construct
  source 1..16: mol_type = other DNA
ctatcatgccttcccc

SEQ ID NO: 384 - DNA, 16 bp, synthetic construct
  source 1..16: mol_type = other DNA
tacatatcaatgcctt

SEQ ID NO: 385 - DNA, 16 bp, synthetic construct
  source 1..16: mol_type = other DNA
tgcagattattatgtg

SEQ ID NO: 386 - DNA, 16 bp, synthetic construct
  source 1..16: mol_type = other DNA
cttatactgaaggctg

SEQ ID NO: 387 - DNA, 16 bp, synthetic construct
  source 1..16: mol_type = other DNA
cattataagctaacta

SEQ ID NO: 388 - DNA, 16 bp, synthetic construct
  source 1..16: mol_type = other DNA
ggctaggattaatcat

SEQ ID NO: 389 - DNA, 16 bp, synthetic construct
  source 1..16: mol_type = other DNA
atccagtaggtgtgtt

SEQ ID NO: 390 - DNA, 16 bp, synthetic construct
  source 1..16: mol_type = other DNA
ataatagctctattgg

SEQ ID NO: 391 - DNA, 16 bp, synthetic construct
  source 1..16: mol_type = other DNA
caagacttaaacacca

SEQ ID NO: 392 - DNA, 16 bp, synthetic construct
  source 1..16: mol_type = other DNA
gggaaattgttgctgt

SEQ ID NO: 393 - DNA, 16 bp, synthetic construct
  source 1..16: mol_type = other DNA
ctgaaattgatacacc

SEQ ID NO: 394 - DNA, 16 bp, synthetic construct
  source 1..16: mol_type = other DNA
aaaccttcatgctagt

SEQ ID NO: 395 - DNA, 16 bp, synthetic construct
  source 1..16: mol_type = other DNA
tagaattaagggctat

SEQ ID NO: 396 - DNA, 16 bp, synthetic construct
  source 1..16: mol_type = other DNA
gattaatcttgatgct

SEQ ID NO: 397 - DNA, 16 bp, synthetic construct
  source 1..16: mol_type = other DNA
atcttaagatacccag

SEQ ID NO: 398 - DNA, 16 bp, synthetic construct
  source 1..16: mol_type = other DNA
gcagttattagaagtc

SEQ ID NO: 399 - DNA, 16 bp, synthetic construct
  source 1..16: mol_type = other DNA
gtaaaattatgccttg

SEQ ID NO: 400 - DNA, 16 bp, synthetic construct
  source 1..16: mol_type = other DNA
gtcctagggaggaggt

SEQ ID NO: 401 - DNA, 16 bp, synthetic construct
  source 1..16: mol_type = other DNA
taggatgatgttcatg

SEQ ID NO: 402 - DNA, 16 bp, synthetic construct
  source 1..16: mol_type = other DNA
caacgactccaagtag

SEQ ID NO: 403 - DNA, 16 bp, synthetic construct
  source 1..16: mol_type = other DNA
agtctgcctgcctatt

SEQ ID NO: 404 - DNA, 16 bp, synthetic construct
  source 1..16: mol_type = other DNA
caccgcgcttattaat

SEQ ID NO: 405 - DNA, 16 bp, synthetic construct
  source 1..16: mol_type = other DNA
acgcctagttttcggc

SEQ ID NO: 406 - DNA, 16 bp, synthetic construct
  source 1..16: mol_type = other DNA
tttagagagcgataga

SEQ ID NO: 407 - DNA, 16 bp, synthetic construct
  source 1..16: mol_type = other DNA
attcaccacgattgtt

SEQ ID NO: 408 - DNA, 16 bp, synthetic construct
  source 1..16: mol_type = other DNA
aagatcggctggatat

SEQ ID NO: 409 - DNA, 16 bp, synthetic construct
  source 1..16: mol_type = other DNA
ttgacctcaaatgtct

SEQ ID NO: 410 - DNA, 16 bp, synthetic construct
  source 1..16: mol_type = other DNA
catcgatggaagaagt

SEQ ID NO: 411 - DNA, 16 bp, synthetic construct
  source 1..16: mol_type = other DNA
ccgcacactgaagcca

SEQ ID NO: 412 - DNA, 16 bp, synthetic construct
  source 1..16: mol_type = other DNA
gcggcaaatttgctgg

SEQ ID NO: 413 - DNA, 16 bp, synthetic construct
  source 1..16: mol_type = other DNA
gaggttttgataccag

SEQ ID NO: 414 - DNA, 16 bp, synthetic construct
  source 1..16: mol_type = other DNA
ctccaatacaggccat

SEQ ID NO: 415 - DNA, 16 bp, synthetic construct
  source 1..16: mol_type = other DNA
ccatctatcagacttc

SEQ ID NO: 416 - DNA, 16 bp, synthetic construct
  source 1..16: mol_type = other DNA
aagatattgatatacg

SEQ ID NO: 417 - DNA, 16 bp, synthetic construct
  source 1..16: mol_type = other DNA
gaatattctgcatacg

SEQ ID NO: 418 - DNA, 16 bp, synthetic construct
  source 1..16: mol_type = other DNA
tacatctctggctgga

SEQ ID NO: 419 - DNA, 16 bp, synthetic construct
  source 1..16: mol_type = other DNA
tgcagcattgattcga

SEQ ID NO: 420 - DNA, 16 bp, synthetic construct
  source 1..16: mol_type = other DNA
gtaattaatcttgttc

SEQ ID NO: 421 - DNA, 16 bp, synthetic construct
  source 1..16: mol_type = other DNA
agggaggtagcttttg

SEQ ID NO: 422 - DNA, 16 bp, synthetic construct
  source 1..16: mol_type = other DNA
ttgaacagtcttaaac

SEQ ID NO: 423 - DNA, 16 bp, synthetic construct
  source 1..16: mol_type = other DNA
tggcatggctacagat

SEQ ID NO: 424 - DNA, 16 bp, synthetic construct
  source 1..16: mol_type = other DNA
atctcttagctgtgca

SEQ ID NO: 425 - DNA, 16 bp, synthetic construct
  source 1..16: mol_type = other DNA
atatgtccaggttgag

SEQ ID NO: 426 - DNA, 16 bp, synthetic construct
  source 1..16: mol_type = other DNA
agaatagagttgcacc

SEQ ID NO: 427 - DNA, 16 bp, synthetic construct
  source 1..16: mol_type = other DNA
gggtccacttttggtg

SEQ ID NO: 428 - DNA, 16 bp, synthetic construct
  source 1..16: mol_type = other DNA
agagtcggtcaccttt

SEQ ID NO: 429 - DNA, 16 bp, synthetic construct
  source 1..16: mol_type = other DNA
gtctaaacatctctgg

SEQ ID NO: 430 - DNA, 16 bp, synthetic construct
  source 1..16: mol_type = other DNA
atgtaatagccagtac

SEQ ID NO: 431 - DNA, 16 bp, synthetic construct
  source 1..16: mol_type = other DNA
tagtgggagtcggatt

SEQ ID NO: 432 - DNA, 16 bp, synthetic construct
  source 1..16: mol_type = other DNA
aagaggatagtccatg

SEQ ID NO: 433 - DNA, 16 bp, synthetic construct
  source 1..16: mol_type = other DNA
agggaatttatcaaac

SEQ ID NO: 434 - DNA, 16 bp, synthetic construct
  source 1..16: mol_type = other DNA
catttagcagcttgga

SEQ ID NO: 435 - DNA, 16 bp, synthetic construct
  source 1..16: mol_type = other DNA
gttgttaatgtagtgt

SEQ ID NO: 436 - DNA, 16 bp, synthetic construct
  source 1..16: mol_type = other DNA
atacgacttccttcta

SEQ ID NO: 437 - DNA, 16 bp, synthetic construct
  source 1..16: mol_type = other DNA
gaaaactcagccagca

SEQ ID NO: 438 - DNA, 16 bp, synthetic construct
  source 1..16: mol_type = other DNA
agctagacaattgcaa

SEQ ID NO: 439 - DNA, 16 bp, synthetic construct
  source 1..16: mol_type = other DNA
ccaaacatggatgtta

SEQ ID NO: 440 - DNA, 16 bp, synthetic construct
  source 1..16: mol_type = other DNA
attatacttttccgtc

SEQ ID NO: 441 - DNA, 16 bp, synthetic construct
  source 1..16: mol_type = other DNA
tttcatagggagacca

SEQ ID NO: 442 - DNA, 16 bp, synthetic construct
  source 1..16: mol_type = other DNA
ctaaagcaggctactt

SEQ ID NO: 443 - DNA, 16 bp, synthetic construct
  source 1..16: mol_type = other DNA
ttaaatcaggcagtca

SEQ ID NO: 444 - DNA, 16 bp, synthetic construct
  source 1..16: mol_type = other DNA
aaagttaataggacta

SEQ ID NO: 445 - DNA, 16 bp, synthetic construct
  source 1..16: mol_type = other DNA
cataacctaataacta

SEQ ID NO: 446 - DNA, 16 bp, synthetic construct
  source 1..16: mol_type = other DNA
tcaaagttttgggacc

SEQ ID NO: 447 - DNA, 16 bp, synthetic construct
  source 1..16: mol_type = other DNA
tccacttgaattctgt

SEQ ID NO: 448 - DNA, 16 bp, synthetic construct
  source 1..16: mol_type = other DNA
gatctagaacacttgc

SEQ ID NO: 449 - DNA, 16 bp, synthetic construct
  source 1..16: mol_type = other DNA
gctggtaaaggtaagg

SEQ ID NO: 450 - DNA, 16 bp, synthetic construct
  source 1..16: mol_type = other DNA
ctccaaattcccaacc

SEQ ID NO: 451 - DNA, 16 bp, synthetic construct
  source 1..16: mol_type = other DNA
aaatcttgtgtaactg

SEQ ID NO: 452 - DNA, 16 bp, synthetic construct
  source 1..16: mol_type = other DNA
gacaatgacatagacg

SEQ ID NO: 453 - DNA, 16 bp, synthetic construct
  source 1..16: mol_type = other DNA
ctgagtaaacgactct

SEQ ID NO: 454 - DNA, 16 bp, synthetic construct
  source 1..16: mol_type = other DNA
caacttttagtcaggt

SEQ ID NO: 455 - DNA, 16 bp, synthetic construct
  source 1..16: mol_type = other DNA
tggcttaatgttcagt

SEQ ID NO: 456 - DNA, 16 bp, synthetic construct
  source 1..16: mol_type = other DNA
attaagcattgttagc

SEQ ID NO: 457 - DNA, 16 bp, synthetic construct
  source 1..16: mol_type = other DNA
caatttatttgctggt

SEQ ID NO: 458 - DNA, 16 bp, synthetic construct
  source 1..16: mol_type = other DNA
tatatactaggattag

SEQ ID NO: 459 - DNA, 16 bp, synthetic construct
  source 1..16: mol_type = other DNA
ctcaaatgaggcggca

SEQ ID NO: 460 - DNA, 16 bp, synthetic construct
  source 1..16: mol_type = other DNA
cgtagcaaatgtaaga

SEQ ID NO: 461 - DNA, 16 bp, synthetic construct
  source 1..16: mol_type = other DNA
atctatcatgccttcc

SEQ ID NO: 462 - DNA, 16 bp, synthetic construct
  source 1..16: mol_type = other DNA
ttacatatcaatgcct

SEQ ID NO: 463 - DNA, 16 bp, synthetic construct
  source 1..16: mol_type = other DNA
gttaaaacttcattcc

SEQ ID NO: 464 - DNA, 16 bp, synthetic construct
  source 1..16: mol_type = other DNA
ccttatactgaaggct

SEQ ID NO: 465 - DNA, 16 bp, synthetic construct
  source 1..16: mol_type = other DNA
tcattataagctaact

SEQ ID NO: 466 - DNA, 16 bp, synthetic construct
  source 1..16: mol_type = other DNA
gaggaatggctaggat

SEQ ID NO: 467 - DNA, 16 bp, synthetic construct
  source 1..16: mol_type = other DNA
catatccagtaggtgt

SEQ ID NO: 468 - DNA, 16 bp, synthetic construct
  source 1..16: mol_type = other DNA
ccataataatagctct

SEQ ID NO: 469 - DNA, 16 bp, synthetic construct
  source 1..16: mol_type = other DNA
aaagttagttgggcga

SEQ ID NO: 470 - DNA, 16 bp, synthetic construct
  source 1..16: mol_type = other DNA
tgggaaattgttgctg

SEQ ID NO: 471 - DNA, 16 bp, synthetic construct
  source 1..16: mol_type = other DNA
actgaaattgatacac

SEQ ID NO: 472 - DNA, 16 bp, synthetic construct
  source 1..16: mol_type = other DNA
gaaaccttcatgctag

SEQ ID NO: 473 - DNA, 16 bp, synthetic construct
  source 1..16: mol_type = other DNA
ctagaattaagggcta

SEQ ID NO: 474 - DNA, 16 bp, synthetic construct
  source 1..16: mol_type = other DNA
tgattaatcttgatgc

SEQ ID NO: 475 - DNA, 16 bp, synthetic construct
  source 1..16: mol_type = other DNA
catcttaagataccca

SEQ ID NO: 476 - DNA, 16 bp, synthetic construct
  source 1..16: mol_type = other DNA
cctaaacaaacactat

SEQ ID NO: 477 - DNA, 16 bp, synthetic construct
  source 1..16: mol_type = other DNA
acagtaaaattatgcc

SEQ ID NO: 478 - DNA, 16 bp, synthetic construct
  source 1..16: mol_type = other DNA
tagtcctagggaggag

SEQ ID NO: 479 - DNA, 16 bp, synthetic construct
  source 1..16: mol_type = other DNA
ctaggatgatgttcat

SEQ ID NO: 480 - DNA, 16 bp, synthetic construct
  source 1..16: mol_type = other DNA
ccaacgactccaagta

SEQ ID NO: 481 - DNA, 16 bp, synthetic construct
  source 1..16: mol_type = other DNA
tagtctgcctgcctat

SEQ ID NO: 482 - DNA, 16 bp, synthetic construct
  source 1..16: mol_type = other DNA
acaccgcgcttattaa

SEQ ID NO: 483 - DNA, 16 bp, synthetic construct
  source 1..16: mol_type = other DNA
gcatgcgcagtgacgc

SEQ ID NO: 484 - DNA, 16 bp, synthetic construct
  source 1..16: mol_type = other DNA
atttagagagcgatag

SEQ ID NO: 485 - DNA, 16 bp, synthetic construct
  source 1..16: mol_type = other DNA
tattcaccacgattgt

SEQ ID NO: 486 - DNA, 16 bp, synthetic construct
  source 1..16: mol_type = other DNA
gaagatcggctggata

SEQ ID NO: 487 - DNA, 16 bp, synthetic construct
  source 1..16: mol_type = other DNA
gttgacctcaaatgtc

SEQ ID NO: 488 - DNA, 16 bp, synthetic construct
  source 1..16: mol_type = other DNA
tcatcgatggaagaag

SEQ ID NO: 489 - DNA, 16 bp, synthetic construct
  source 1..16: mol_type = other DNA
gccgcacactgaagcc

SEQ ID NO: 490 - DNA, 16 bp, synthetic construct
  source 1..16: mol_type = other DNA
agcggcaaatttgctg

SEQ ID NO: 491 - DNA, 16 bp, synthetic construct
  source 1..16: mol_type = other DNA
tgaggttttgatacca

SEQ ID NO: 492 - DNA, 16 bp, synthetic construct
  source 1..16: mol_type = other DNA
tctccaatacaggcca

SEQ ID NO: 493 - DNA, 16 bp, synthetic construct
  source 1..16: mol_type = other DNA
tccatctatcagactt

SEQ ID NO: 494 - DNA, 16 bp, synthetic construct
  source 1..16: mol_type = other DNA
gtagtctcagaaagat

SEQ ID NO: 495 - DNA, 16 bp, synthetic construct
  source 1..16: mol_type = other DNA
cactgcttcaaattga

SEQ ID NO: 496 - DNA, 16 bp, synthetic construct
  source 1..16: mol_type = other DNA
atacatctctggctgg

SEQ ID NO: 497 - DNA, 16 bp, synthetic construct
  source 1..16: mol_type = other DNA
ttgcagcattgattcg

SEQ ID NO: 498 - DNA, 16 bp, synthetic construct
  source 1..16: mol_type = other DNA
ggtaattaatcttgtt

SEQ ID NO: 499 - DNA, 16 bp, synthetic construct
  source 1..16: mol_type = other DNA
tagggaggtagctttt

SEQ ID NO: 500 - DNA, 16 bp, synthetic construct
  source 1..16: mol_type = other DNA
cttgaacagtcttaaa

SEQ ID NO: 501 - DNA, 16 bp, synthetic construct
  source 1..16: mol_type = other DNA
gtggcatggctacaga

SEQ ID NO: 502 - DNA, 16 bp, synthetic construct
  source 1..16: mol_type = other DNA
gatctcttagctgtgc

SEQ ID NO: 503 - DNA, 16 bp, synthetic construct
  source 1..16: mol_type = other DNA
aatatgtccaggttga

SEQ ID NO: 504 - DNA, 16 bp, synthetic construct
  source 1..16: mol_type = other DNA
cagaatagagttgcac

SEQ ID NO: 505 - DNA, 16 bp, synthetic construct
  source 1..16: mol_type = other DNA
agggtccacttttggt

SEQ ID NO: 506 - DNA, 16 bp, synthetic construct
  source 1..16: mol_type = other DNA
tagagtcggtcacctt

SEQ ID NO: 507 - DNA, 16 bp, synthetic construct
  source 1..16: mol_type = other DNA
tgtctaaacatctctg

SEQ ID NO: 508 - DNA, 16 bp, synthetic construct
  source 1..16: mol_type = other DNA
tatgtaatagccagta

SEQ ID NO: 509 - DNA, 16 bp, synthetic construct
  source 1..16: mol_type = other DNA
gtagtgggagtcggat

SEQ ID NO: 510 - DNA, 16 bp, synthetic construct
  source 1..16: mol_type = other DNA
caagaggatagtccat

SEQ ID NO: 511 - DNA, 16 bp, synthetic construct
  source 1..16: mol_type = other DNA
agactaagggaccagg

SEQ ID NO: 512 - DNA, 16 bp, synthetic construct
  source 1..16: mol_type = other DNA
tcatttagcagcttgg

SEQ ID NO: 513 - DNA, 16 bp, synthetic construct
  source 1..16: mol_type = other DNA
acaatttttccaatcc

SEQ ID NO: 514 - DNA, 16 bp, synthetic construct
  source 1..16: mol_type = other DNA
aatacgacttccttct

SEQ ID NO: 515 - DNA, 16 bp, synthetic construct
  source 1..16: mol_type = other DNA
tgaaaactcagccagc

SEQ ID NO: 516 - DNA, 16 bp, synthetic construct
  source 1..16: mol_type = other DNA
ttataactgagctaga

SEQ ID NO: 517 - DNA, 16 bp, synthetic construct
  source 1..16: mol_type = other DNA
cccaaacatggatgtt

SEQ ID NO: 518 - DNA, 16 bp, synthetic construct
  source 1..16: mol_type = other DNA
aattatacttttccgt

SEQ ID NO: 519 - DNA, 16 bp, synthetic construct
  source 1..16: mol_type = other DNA
ctttcatagggagacc

SEQ ID NO: 520 - DNA, 16 bp, synthetic construct
  source 1..16: mol_type = other DNA
tctaaagcaggctact

SEQ ID NO: 521 - DNA, 16 bp, synthetic construct
  source 1..16: mol_type = other DNA
ccaatttaaatcaggc

SEQ ID NO: 522 - DNA, 16 bp, synthetic construct
  source 1..16: mol_type = other DNA
caaagttaataggact

SEQ ID NO: 523 - DNA, 16 bp, synthetic construct
  source 1..16: mol_type = other DNA
gtctaaagtgctggtt

SEQ ID NO: 524 - DNA, 16 bp, synthetic construct
  source 1..16: mol_type = other DNA
gaacactttcactggg

SEQ ID NO: 525 - DNA, 16 bp, synthetic construct
  source 1..16: mol_type = other DNA
accaagtagcttacat

SEQ ID NO: 526 - DNA, 16 bp, synthetic construct
  source 1..16: mol_type = other DNA
ggatctagaacacttg

SEQ ID NO: 527 - DNA, 16 bp, synthetic construct
  source 1..16: mol_type = other DNA
atgtgaagagctggta

SEQ ID NO: 528 - DNA, 16 bp, synthetic construct
  source 1..16: mol_type = other DNA
cccaagctacctccaa

SEQ ID NO: 529 - DNA, 16 bp, synthetic construct
  source 1..16: mol_type = other DNA
gtgaaatcttgtgtaa

SEQ ID NO: 530 - DNA, 16 bp, synthetic construct
  source 1..16: mol_type = other DNA
agacaatgacatagac

SEQ ID NO: 531 - DNA, 16 bp, synthetic construct
  source 1..16: mol_type = other DNA
actgagtaaacgactc

SEQ ID NO: 532 - DNA, 16 bp, synthetic construct
  source 1..16: mol_type = other DNA
ccctttatgtctttgg

SEQ ID NO: 533 - DNA, 16 bp, synthetic construct
  source 1..16: mol_type = other DNA
ctattgattggcttaa

SEQ ID NO: 534 - DNA, 16 bp, synthetic construct
  source 1..16: mol_type = other DNA
aaatttgctggaactg

SEQ ID NO: 535 - DNA, 16 bp, synthetic construct
  source 1..16: mol_type = other DNA
agctagatactcaatt

SEQ ID NO: 536 - DNA, 16 bp, synthetic construct
  source 1..16: mol_type = other DNA
gaatatatactaggat

SEQ ID NO: 537 - DNA, 16 bp, synthetic construct
  source 1..16: mol_type = other DNA
cctcaaatgaggcggc

SEQ ID NO: 538 - DNA, 16 bp, synthetic construct
  source 1..16: mol_type = other DNA
attaagtactgtgaga

SEQ ID NO: 539 - DNA, 16 bp, synthetic construct
  source 1..16: mol_type = other DNA
catctatcatgccttc

SEQ ID NO: 540 - DNA, 16 bp, synthetic construct
  source 1..16: mol_type = other DNA
attacatatcaatgcc

SEQ ID NO: 541 - DNA, 16 bp, synthetic construct
  source 1..16: mol_type = other DNA
agcgaatgttaaaact

SEQ ID NO: 542 - DNA, 16 bp, synthetic construct
  source 1..16: mol_type = other DNA
tccttatactgaaggc

SEQ ID NO: 543 - DNA, 16 bp, synthetic construct
  source 1..16: mol_type = other DNA
ctcattataagctaac

SEQ ID NO: 544 - DNA, 16 bp, synthetic construct
  source 1..16: mol_type = other DNA
agtagtggagccagac

SEQ ID NO: 545 - DNA, 16 bp, synthetic construct
  source 1..16: mol_type = other DNA
tcatatccagtaggtg

SEQ ID NO: 546 - DNA, 16 bp, synthetic construct
  source 1..16: mol_type = other DNA
tccataataatagctc

SEQ ID NO: 547 - DNA, 16 bp, synthetic construct
  source 1..16: mol_type = other DNA
cgtcaaaaaccgtcaa

SEQ ID NO: 548 - DNA, 16 bp, synthetic construct
  source 1..16: mol_type = other DNA
gagtatttcctctggg

SEQ ID NO: 549 - DNA, 16 bp, synthetic construct
  source 1..16: mol_type = other DNA
actaatttagtcaact

SEQ ID NO: 550 - DNA, 16 bp, synthetic construct
  source 1..16: mol_type = other DNA
tttaactaccctcaca

SEQ ID NO: 551 - DNA, 16 bp, synthetic construct
  source 1..16: mol_type = other DNA
tctagaattaagggct

SEQ ID NO: 552 - DNA, 16 bp, synthetic construct
  source 1..16: mol_type = other DNA
ctgattaatcttgatg

SEQ ID NO: 553 - DNA, 16 bp, synthetic construct
  source 1..16: mol_type = other DNA
gcatcttaagataccc

SEQ ID NO: 554 - DNA, 16 bp, synthetic construct
  source 1..16: mol_type = other DNA
gcctaaacaaacacta

SEQ ID NO: 555 - DNA, 16 bp, synthetic construct
  source 1..16: mol_type = other DNA
catagtggacttcatt

SEQ ID NO: 556 - DNA, 16 bp, synthetic construct
  source 1..16: mol_type = other DNA
gtagtcctagggagga

SEQ ID NO: 557 - DNA, 16 bp, synthetic construct
  source 1..16: mol_type = other DNA
tctaggatgatgttca

SEQ ID NO: 558 - DNA, 16 bp, synthetic construct
  source 1..16: mol_type = other DNA
accaacgactccaagt

SEQ ID NO: 559 - DNA, 16 bp, synthetic construct
  source 1..16: mol_type = other DNA
gtagtctgcctgccta

SEQ ID NO: 560 - DNA, 16 bp, synthetic construct
  source 1..16: mol_type = other DNA
cacaccgcgcttatta

SEQ ID NO: 561 - DNA, 16 bp, synthetic construct
  source 1..16: mol_type = other DNA
cgcatgcgcagtgacg

SEQ ID NO: 562 - DNA, 16 bp, synthetic construct
  source 1..16: mol_type = other DNA
gatttagagagcgata

SEQ ID NO: 563 - DNA, 16 bp, synthetic construct
  source 1..16: mol_type = other DNA
ttattcaccacgattg

SEQ ID NO: 564 - DNA, 16 bp, synthetic construct
  source 1..16: mol_type = other DNA
agaagatcggctggat

SEQ ID NO: 565 - DNA, 16 bp, synthetic construct
  source 1..16: mol_type = other DNA
tgttgacctcaaatgt

SEQ ID NO: 566 - DNA, 16 bp, synthetic construct
  source 1..16: mol_type = other DNA
atcatcgatggaagaa

SEQ ID NO: 567 - DNA, 16 bp, synthetic construct
  source 1..16: mol_type = other DNA
ggccgcacactgaagc

SEQ ID NO: 568 - DNA, 16 bp, synthetic construct
  source 1..16: mol_type = other DNA
gccaacagcggcaaat

SEQ ID NO: 569 - DNA, 16 bp, synthetic construct
  source 1..16: mol_type = other DNA
atgaggttttgatacc

SEQ ID NO: 570 - DNA, 16 bp, synthetic construct
  source 1..16: mol_type = other DNA
gtctccaatacaggcc

SEQ ID NO: 571 - DNA, 16 bp, synthetic construct
  source 1..16: mol_type = other DNA
ttccatctatcagact

SEQ ID NO: 572 - DNA, 16 bp, synthetic construct
  source 1..16: mol_type = other DNA
aaacttctgtagtctc

SEQ ID NO: 573 - DNA, 16 bp, synthetic construct
  source 1..16: mol_type = other DNA
ccactgcttcaaattg

SEQ ID NO: 574 - DNA, 16 bp, synthetic construct
  source 1..16: mol_type = other DNA
catacatctctggctg

SEQ ID NO: 575 - DNA, 16 bp, synthetic construct
  source 1..16: mol_type = other DNA
tttgcagcattgattc

SEQ ID NO: 576 - DNA, 16 bp, synthetic construct
  source 1..16: mol_type = other DNA
caggtaattaatcttg

SEQ ID NO: 577 - DNA, 16 bp, synthetic construct
  source 1..16: mol_type = other DNA
ttagggaggtagcttt

SEQ ID NO: 578 - DNA, 16 bp, synthetic construct
  source 1..16: mol_type = other DNA
acttgaacagtcttaa

SEQ ID NO: 579 - DNA, 16 bp, synthetic construct
  source 1..16: mol_type = other DNA
tgtggcatggctacag

SEQ ID NO: 580 - DNA, 16 bp, synthetic construct
  source 1..16: mol_type = other DNA
tgatctcttagctgtg

SEQ ID NO: 581 - DNA, 16 bp, synthetic construct
  source 1..16: mol_type = other DNA
aaatatgtccaggttg

SEQ ID NO: 582 - DNA, 16 bp, synthetic construct
  source 1..16: mol_type = other DNA
ccagaatagagttgca

SEQ ID NO: 583 - DNA, 16 bp, synthetic construct
  source 1..16: mol_type = other DNA
gagggtccacttttgg

SEQ ID NO: 584 - DNA, 16 bp, synthetic construct
  source 1..16: mol_type = other DNA
atagagtcggtcacct

SEQ ID NO: 585 - DNA, 16 bp, synthetic construct
  source 1..16: mol_type = other DNA
attgtctaaacatctc

SEQ ID NO: 586 - DNA, 16 bp, synthetic construct
  source 1..16: mol_type = other DNA
ttatgtaatagccagt

SEQ ID NO: 587 - DNA, 16 bp, synthetic construct
  source 1..16: mol_type = other DNA
tgtagtgggagtcgga

SEQ ID NO: 588 - DNA, 16 bp, synthetic construct
  source 1..16: mol_type = other DNA
acaagaggatagtcca

SEQ ID NO: 589 - DNA, 16 bp, synthetic construct
  source 1..16: mol_type = other DNA
cagactaagggaccag

SEQ ID NO: 590 - DNA, 16 bp, synthetic construct
  source 1..16: mol_type = other DNA
ctcatttagcagcttg

SEQ ID NO: 591 - DNA, 16 bp, synthetic construct
  source 1..16: mol_type = other DNA
caaggagtacttcaca

SEQ ID NO: 592 - DNA, 16 bp, synthetic construct
  source 1..16: mol_type = other DNA
taatacgacttccttc

SEQ ID NO: 593 - DNA, 16 bp, synthetic construct
  source 1..16: mol_type = other DNA
gcaaaaggagccagtt

SEQ ID NO: 594 - DNA, 16 bp, synthetic construct
  source 1..16: mol_type = other DNA
gttttataactgagct

SEQ ID NO: 595 - DNA, 16 bp, synthetic construct
  source 1..16: mol_type = other DNA
ctaaaccctggagcag

SEQ ID NO: 596 - DNA, 16 bp, synthetic construct
  source 1..16: mol_type = other DNA
aaattatacttttccg

SEQ ID NO: 597 - DNA, 16 bp, synthetic construct
  source 1..16: mol_type = other DNA
gaagaaggactttcat

SEQ ID NO: 598 - DNA, 16 bp, synthetic construct
  source 1..16: mol_type = other DNA
ctctaaagcaggctac

SEQ ID NO: 599 - DNA, 16 bp, synthetic construct
  source 1..16: mol_type = other DNA
tccaatttaaatcagg

SEQ ID NO: 600 - DNA, 16 bp, synthetic construct
  source 1..16: mol_type = other DNA
gcaaagttaataggac

SEQ ID NO: 601 - DNA, 16 bp, synthetic construct
  source 1..16: mol_type = other DNA
tggtctaaagtgctgg

SEQ ID NO: 602 - DNA, 16 bp, synthetic construct
  source 1..16: mol_type = other DNA
cccaaaaatgtcctag

SEQ ID NO: 603 - DNA, 16 bp, synthetic construct
  source 1..16: mol_type = other DNA
gaccaagtagcttaca

SEQ ID NO: 604 - DNA, 16 bp, synthetic construct
  source 1..16: mol_type = other DNA
atggatctagaacact

SEQ ID NO: 605 - DNA, 16 bp, synthetic construct
  source 1..16: mol_type = other DNA
atatgtgaagagctgg

SEQ ID NO: 606 - DNA, 16 bp, synthetic construct
  source 1..16: mol_type = other DNA
acccaagctacctcca

SEQ ID NO: 607 - DNA, 16 bp, synthetic construct
  source 1..16: mol_type = other DNA
agtgaaatcttgtgta

SEQ ID NO: 608 - DNA, 16 bp, synthetic construct
  source 1..16: mol_type = other DNA
gatcattgcagaaaga

SEQ ID NO: 609 - DNA, 16 bp, synthetic construct
  source 1..16: mol_type = other DNA
acatatggtgtacact

SEQ ID NO: 610 - DNA, 16 bp, synthetic construct
  source 1..16: mol_type = other DNA
gcaaatacagcagtac

SEQ ID NO: 611 - DNA, 16 bp, synthetic construct
  source 1..16: mol_type = other DNA
tctattgattggctta

SEQ ID NO: 612 - DNA, 16 bp, synthetic construct
  source 1..16: mol_type = other DNA
caaatttgctggaact

SEQ ID NO: 613 - DNA, 16 bp, synthetic construct
  source 1..16: mol_type = other DNA
aaggagctagatactc

SEQ ID NO: 614 - DNA, 16 bp, synthetic construct
  source 1..16: mol_type = other DNA
cagaatatatactagg

SEQ ID NO: 615 - DNA, 16 bp, synthetic construct
  source 1..16: mol_type = other DNA
taagagtcagtatcct

SEQ ID NO: 616 - DNA, 16 bp, synthetic construct
  source 1..16: mol_type = other DNA
tattaagtactgtgag

SEQ ID NO: 617 - DNA, 16 bp, synthetic construct
  source 1..16: mol_type = other DNA
cattatccttactccc

SEQ ID NO: 618 - DNA, 16 bp, synthetic construct
  source 1..16: mol_type = other DNA
cattacatatcaatgc

SEQ ID NO: 619 - DNA, 16 bp, synthetic construct
  source 1..16: mol_type = other DNA
agttagggagccagcg

SEQ ID NO: 620 - DNA, 16 bp, synthetic construct
  source 1..16: mol_type = other DNA
ctggaggtatgtcata

SEQ ID NO: 621 - DNA, 16 bp, synthetic construct
  source 1..16: mol_type = other DNA
tgataaaatagggtgc

SEQ ID NO: 622 - DNA, 16 bp, synthetic construct
  source 1..16: mol_type = other DNA
gagtagtggagccaga

SEQ ID NO: 623 - DNA, 16 bp, synthetic construct
  source 1..16: mol_type = other DNA
tttcatatccagtagg

SEQ ID NO: 624 - DNA, 16 bp, synthetic construct
  source 1..16: mol_type = other DNA
aataactgttctcccc

SEQ ID NO: 625 - DNA, 16 bp, synthetic construct
  source 1..16: mol_type = other DNA
gacaacaaacaatggg

SEQ ID NO: 626 - DNA, 16 bp, synthetic construct
  source 1..16: mol_type = other DNA
agagtatttcctctgg

SEQ ID NO: 627 - DNA, 16 bp, synthetic construct
  source 1..16: mol_type = other DNA
cactaatttagtcaac

SEQ ID NO: 628 - DNA, 16 bp, synthetic construct
  source 1..16: mol_type = other DNA
ttttaactaccctcac

SEQ ID NO: 629 - DNA, 16 bp, synthetic construct
  source 1..16: mol_type = other DNA
atctagaattaagggc

SEQ ID NO: 630 - DNA, 16 bp, synthetic construct
  source 1..16: mol_type = other DNA
gctgattaatcttgat

SEQ ID NO: 631 - DNA, 16 bp, synthetic construct
  source 1..16: mol_type = other DNA
tccaaggagtgcatct

SEQ ID NO: 632 - DNA, 16 bp, synthetic construct
  source 1..16: mol_type = other DNA
ttattgcctgaacaca

SEQ ID NO: 633 - DNA, 16 bp, synthetic construct
  source 1..16: mol_type = other DNA
tcatagtggacttcat

SEQ ID NO: 634 - DNA, 16 bp, synthetic construct
  source 1..16: mol_type = other DNA
tgtagtcctagggagg

SEQ ID NO: 635 - DNA, 16 bp, synthetic construct
  source 1..16: mol_type = other DNA
ttctaggatgatgttc

SEQ ID NO: 636 - DNA, 16 bp, synthetic construct
  source 1..16: mol_type = other DNA
caccaacgactccaag

SEQ ID NO: 637 - DNA, 16 bp, synthetic construct
  source 1..16: mol_type = other DNA
taagtagtctgcctgc

SEQ ID NO: 638 - DNA, 16 bp, synthetic construct
  source 1..16: mol_type = other DNA
tccacaccgcgcttat

SEQ ID NO: 639 - DNA, 16 bp, synthetic construct
  source 1..16: mol_type = other DNA
acgcatgcgcagtgac

SEQ ID NO: 640 - DNA, 16 bp, synthetic construct
  source 1..16: mol_type = other DNA
tgatttagagagcgat

SEQ ID NO: 641 - DNA, 16 bp, synthetic construct
  source 1..16: mol_type = other DNA
attattcaccacgatt

SEQ ID NO: 642 - DNA, 16 bp, synthetic construct
  source 1..16: mol_type = other DNA
gagaagatcggctgga

SEQ ID NO: 643 - DNA, 16 bp, synthetic construct
  source 1..16: mol_type = other DNA
atgttgacctcaaatg

SEQ ID NO: 644 - DNA, 16 bp, synthetic construct
  source 1..16: mol_type = other DNA
catcatcgatggaaga

SEQ ID NO: 645 - DNA, 16 bp, synthetic construct
  source 1..16: mol_type = other DNA
tggccgcacactgaag

SEQ ID NO: 646 - DNA, 16 bp, synthetic construct
  source 1..16: mol_type = other DNA
gtgaaagccaacagcg

SEQ ID NO: 647 - DNA, 16 bp, synthetic construct
  source 1..16: mol_type = other DNA
gacatgaggttttgat

SEQ ID NO: 648 - DNA, 16 bp, synthetic construct
  source 1..16: mol_type = other DNA
tgtctccaatacaggc

SEQ ID NO: 649 - DNA, 16 bp, synthetic construct
  source 1..16: mol_type = other DNA
attccatctatcagac

SEQ ID NO: 650 - DNA, 16 bp, synthetic construct
  source 1..16: mol_type = other DNA
gaaacttctgtagtct

SEQ ID NO: 651 - DNA, 16 bp, synthetic construct
  source 1..16: mol_type = other DNA
ccaaccactgcttcaa

SEQ ID NO: 652 - DNA, 16 bp, synthetic construct
  source 1..16: mol_type = other DNA
gcatacatctctggct

SEQ ID NO: 653 - DNA, 16 bp, synthetic construct
  source 1..16: mol_type = other DNA
gctttgcagcattgat

SEQ ID NO: 654 - DNA, 16 bp, synthetic construct
  source 1..16: mol_type = other DNA
acaggtaattaatctt

SEQ ID NO: 655 - DNA, 16 bp, synthetic construct
  source 1..16: mol_type = other DNA
tttagggaggtagctt

SEQ ID NO: 656 - DNA, 16 bp, synthetic construct
  source 1..16: mol_type = other DNA
tacttgaacagtctta

SEQ ID NO: 657 - DNA, 16 bp, synthetic construct
  source 1..16: mol_type = other DNA
ctgtggcatggctaca

SEQ ID NO: 658 - DNA, 16 bp, synthetic construct
  source 1..16: mol_type = other DNA
ttgatctcttagctgt

SEQ ID NO: 659 - DNA, 16 bp, synthetic construct
  source 1..16: mol_type = other DNA
ctagggaaatctttca

SEQ ID NO: 660 - DNA, 16 bp, synthetic construct
  source 1..16: mol_type = other DNA
tccagaatagagttgc

SEQ ID NO: 661 - DNA, 16 bp, synthetic construct
  source 1..16: mol_type = other DNA
agagggtccacttttg

SEQ ID NO: 662 - DNA, 16 bp, synthetic construct
  source 1..16: mol_type = other DNA
aatagagtcggtcacc

SEQ ID NO: 663 - DNA, 16 bp, synthetic construct
  source 1..16: mol_type = other DNA
gcctaaaattgtctaa

SEQ ID NO: 664 - DNA, 16 bp, synthetic construct
  source 1..16: mol_type = other DNA
cttatgtaatagccag

SEQ ID NO: 665 - DNA, 16 bp, synthetic construct
  source 1..16: mol_type = other DNA
atgtagtgggagtcgg

SEQ ID NO: 666 - DNA, 16 bp, synthetic construct
  source 1..16: mol_type = other DNA
aacaagaggatagtcc

SEQ ID NO: 667 - DNA, 16 bp, synthetic construct
  source 1..16: mol_type = other DNA
acagactaagggacca

SEQ ID NO: 668 - DNA, 16 bp, synthetic construct
  source 1..16: mol_type = other DNA
cctcatttagcagctt

SEQ ID NO: 669 - DNA, 16 bp, synthetic construct
  source 1..16: mol_type = other DNA
ctcaaggagtacttca

SEQ ID NO: 670 - DNA, 16 bp, synthetic construct
  source 1..16: mol_type = other DNA
ttaatacgacttcctt

SEQ ID NO: 671 - DNA, 16 bp, synthetic construct
  source 1..16: mol_type = other DNA
ggcaaaaggagccagt

SEQ ID NO: 672 - DNA, 16 bp, synthetic construct
  source 1..16: mol_type = other DNA
gttaccagagcattca

SEQ ID NO: 673 - DNA, 16 bp, synthetic construct
  source 1..16: mol_type = other DNA
gctaaaccctggagca

SEQ ID NO: 674 - DNA, 16 bp, synthetic construct
  source 1..16: mol_type = other DNA
caagttttcacctcag

SEQ ID NO: 675 - DNA, 16 bp, synthetic construct
  source 1..16: mol_type = other DNA
gggaaagaagtctcct

SEQ ID NO: 676 - DNA, 16 bp, synthetic construct
  source 1..16: mol_type = other DNA
tctctaaagcaggcta

SEQ ID NO: 677 - DNA, 16 bp, synthetic construct
  source 1..16: mol_type = other DNA
tagcagctaaaatcca

SEQ ID NO: 678 - DNA, 16 bp, synthetic construct
  source 1..16: mol_type = other DNA
tgcaaagttaatagga

SEQ ID NO: 679 - DNA, 16 bp, synthetic construct
  source 1..16: mol_type = other DNA
ctatataaattctgac

SEQ ID NO: 680 - DNA, 16 bp, synthetic construct
  source 1..16: mol_type = other DNA
taagagaaggtgcaca

SEQ ID NO: 681 - DNA, 16 bp, synthetic construct
  source 1..16: mol_type = other DNA
gatactggtggacaag

SEQ ID NO: 682 - DNA, 16 bp, synthetic construct
  source 1..16: mol_type = other DNA
gtatagctgcatttct

SEQ ID NO: 683 - DNA, 16 bp, synthetic construct
  source 1..16: mol_type = other DNA
catatgtgaagagctg

SEQ ID NO: 684 - DNA, 16 bp, synthetic construct
  source 1..16: mol_type = other DNA
aactagaactcccaac

SEQ ID NO: 685 - DNA, 16 bp, synthetic construct
  source 1..16: mol_type = other DNA
ggctttatcattctaa

SEQ ID NO: 686 - DNA, 16 bp, synthetic construct
  source 1..16: mol_type = other DNA
taaggatcattgcaga

SEQ ID NO: 687 - DNA, 16 bp, synthetic construct
  source 1..16: mol_type = other DNA
ccatttacatatggtg

SEQ ID NO: 688 - DNA, 16 bp, synthetic construct
  source 1..16: mol_type = other DNA
ggcaaatacagcagta

SEQ ID NO: 689 - DNA, 16 bp, synthetic construct
  source 1..16: mol_type = other DNA
ctctattgattggctt

SEQ ID NO: 690 - DNA, 16 bp, synthetic construct
  source 1..16: mol_type = other DNA
cttaccttgtgcttgg

SEQ ID NO: 691 - DNA, 16 bp, synthetic construct
  source 1..16: mol_type = other DNA
gactaaggagctagat

SEQ ID NO: 692 - DNA, 16 bp, synthetic construct
  source 1..16: mol_type = other DNA
gcagaatatatactag

SEQ ID NO: 693 - DNA, 16 bp, synthetic construct
  source 1..16: mol_type = other DNA
gctgtaagagtcagta

SEQ ID NO: 694 - DNA, 16 bp, synthetic construct
  source 1..16: mol_type = other DNA
cttattaagtactgtg

SEQ ID NO: 695 - DNA, 16 bp, synthetic construct
  source 1..16: mol_type = other DNA
ccattatccttactcc

SEQ ID NO: 696 - DNA, 16 bp, synthetic construct
  source 1..16: mol_type = other DNA
ctacatggatccaaca

SEQ ID NO: 697 - DNA, 16 bp, synthetic construct
  source 1..16: mol_type = other DNA
gaggagttagggagcc

SEQ ID NO: 698 - DNA, 16 bp, synthetic construct
  source 1..16: mol_type = other DNA
acaactggaggtatgt

SEQ ID NO: 699 - DNA, 16 bp, synthetic construct
  source 1..16: mol_type = other DNA
ttgataaaatagggtg

SEQ ID NO: 700 - DNA, 16 bp, synthetic construct
  source 1..16: mol_type = other DNA
aggagtagtggagcca

SEQ ID NO: 701 - DNA, 16 bp, synthetic construct
  source 1..16: mol_type = other DNA
tatcagaaacttatac

SEQ ID NO: 702 - DNA, 16 bp, synthetic construct
  source 1..16: mol_type = other DNA
gaaataactgttctcc

SEQ ID NO: 703 - DNA, 16 bp, synthetic construct
  source 1..16: mol_type = other DNA
tccaatatatactgac

SEQ ID NO: 704 - DNA, 16 bp, synthetic construct
  source 1..16: mol_type = other DNA
gctgagagagtatttc

SEQ ID NO: 705 - DNA, 16 bp, synthetic construct
  source 1..16: mol_type = other DNA
acactaatttagtcaa

SEQ ID NO: 706 - DNA, 16 bp, synthetic construct
  source 1..16: mol_type = other DNA
cttttaactaccctca

SEQ ID NO: 707 - DNA, 16 bp, synthetic construct
  source 1..16: mol_type = other DNA
ccatctagaattaagg

SEQ ID NO: 708 - DNA, 16 bp, synthetic construct
  source 1..16: mol_type = other DNA
actgaaggtctgagct

SEQ ID NO: 709 - DNA, 16 bp, synthetic construct
  source 1..16: mol_type = other DNA
ctccaaggagtgcatc

SEQ ID NO: 710 - DNA, 16 bp, synthetic construct
  source 1..16: mol_type = other DNA
aaattattgcctgaac

SEQ ID NO: 711 - DNA, 16 bp, synthetic construct
  source 1..16: mol_type = other DNA
cttcatagtggacttc

SEQ ID NO: 712 - DNA, 16 bp, synthetic construct
  source 1..16: mol_type = other DNA
gtgtagtcctagggag

SEQ ID NO: 713 - DNA, 16 bp, synthetic construct
  source 1..16: mol_type = other DNA
gatttctaggatgatg

SEQ ID NO: 714 - DNA, 16 bp, synthetic construct
  source 1..16: mol_type = other DNA
tcaccaacgactccaa

SEQ ID NO: 715 - DNA, 16 bp, synthetic construct
  source 1..16: mol_type = other DNA
ataagtagtctgcctg

SEQ ID NO: 716 - DNA, 16 bp, synthetic construct
  source 1..16: mol_type = other DNA
ctccacaccgcgctta

SEQ ID NO: 717 - DNA, 16 bp, synthetic construct
  source 1..16: mol_type = other DNA
tacgcatgcgcagtga

SEQ ID NO: 718 - DNA, 16 bp, synthetic construct
  source 1..16: mol_type = other DNA
ctgatttagagagcga

SEQ ID NO: 719 - DNA, 16 bp, synthetic construct
  source 1..16: mol_type = other DNA
cattattcaccacgat

SEQ ID NO: 720 - DNA, 16 bp, synthetic construct
  source 1..16: mol_type = other DNA
tgagaagatcggctgg

SEQ ID NO: 721 - DNA, 16 bp, synthetic construct
  source 1..16: mol_type = other DNA
gatgttgacctcaaat

SEQ ID NO: 722 - DNA, 16 bp, synthetic construct
  source 1..16: mol_type = other DNA
ccatcatcgatggaag

SEQ ID NO: 723 - DNA, 16 bp, synthetic construct
  source 1..16: mol_type = other DNA
gtggccgcacactgaa

SEQ ID NO: 724 - DNA, 16 bp, synthetic construct
  source 1..16: mol_type = other DNA
ctctgtgaaagccaac

SEQ ID NO: 725 - DNA, 16 bp, synthetic construct
  source 1..16: mol_type = other DNA
gagacatgaggttttg

SEQ ID NO: 726 - DNA, 16 bp, synthetic construct
  source 1..16: mol_type = other DNA
ctgtctccaatacagg

SEQ ID NO: 727 - DNA, 16 bp, synthetic construct
  source 1..16: mol_type = other DNA
gtattccatctatcag

SEQ ID NO: 728 - DNA, 16 bp, synthetic construct
  source 1..16: mol_type = other DNA
cgttcaggaagaaact

SEQ ID NO: 729 - DNA, 16 bp, synthetic construct
  source 1..16: mol_type = other DNA
gccaaccactgcttca

SEQ ID NO: 730 - DNA, 16 bp, synthetic construct
  source 1..16: mol_type = other DNA
tgcatacatctctggc

SEQ ID NO: 731 - DNA, 16 bp, synthetic construct
  source 1..16: mol_type = other DNA
agctttgcagcattga

SEQ ID NO: 732 - DNA, 16 bp, synthetic construct
  source 1..16: mol_type = other DNA
gacaggtaattaatct

SEQ ID NO: 733 - DNA, 16 bp, synthetic construct
  source 1..16: mol_type = other DNA
ttttagggaggtagct

SEQ ID NO: 734 - DNA, 16 bp, synthetic construct
  source 1..16: mol_type = other DNA
ctacttgaacagtctt

SEQ ID NO: 735 - DNA, 16 bp, synthetic construct
  source 1..16: mol_type = other DNA
tctgtggcatggctac

SEQ ID NO: 736 - DNA, 16 bp, synthetic construct
  source 1..16: mol_type = other DNA
cttgatctcttagctg

SEQ ID NO: 737 - DNA, 16 bp, synthetic construct
  source 1..16: mol_type = other DNA
gctagggaaatctttc

SEQ ID NO: 738 - DNA, 16 bp, synthetic construct
  source 1..16: mol_type = other DNA
gtccagaatagagttg

SEQ ID NO: 739 - DNA, 16 bp, synthetic construct
  source 1..16: mol_type = other DNA
tagagggtccactttt

SEQ ID NO: 740 - DNA, 16 bp, synthetic construct
  source 1..16: mol_type = other DNA
aaatagagtcggtcac

SEQ ID NO: 741 - DNA, 16 bp, synthetic construct
  source 1..16: mol_type = other DNA
agcctaaaattgtcta

SEQ ID NO: 742 - DNA, 16 bp, synthetic construct
  source 1..16: mol_type = other DNA
tcttatgtaatagcca

SEQ ID NO: 743 - DNA, 16 bp, synthetic construct
  source 1..16: mol_type = other DNA
gatgtagtgggagtcg

SEQ ID NO: 744 - DNA, 16 bp, synthetic construct
  source 1..16: mol_type = other DNA
aaacaagaggatagtc

SEQ ID NO: 745 - DNA, 16 bp, synthetic construct
  source 1..16: mol_type = other DNA
tatacagactaaggga

SEQ ID NO: 746 - DNA, 16 bp, synthetic construct
  source 1..16: mol_type = other DNA
gataatatgtgacttg

SEQ ID NO: 747 - DNA, 16 bp, synthetic construct
  source 1..16: mol_type = other DNA
tctcaaggagtacttc

SEQ ID NO: 748 - DNA, 16 bp, synthetic construct
  source 1..16: mol_type = other DNA
tttaatacgacttcct

SEQ ID NO: 749 - DNA, 16 bp, synthetic construct
  source 1..16: mol_type = other DNA
caaactgctactgtgt

SEQ ID NO: 750 - DNA, 16 bp, synthetic construct
  source 1..16: mol_type = other DNA
taggctaaaccctgga

SEQ ID NO: 751 - DNA, 16 bp, synthetic construct
  source 1..16: mol_type = other DNA
ctctaatgtttcttga

SEQ ID NO: 752 - DNA, 16 bp, synthetic construct
  source 1..16: mol_type = other DNA
taaactgtatgcctct

SEQ ID NO: 753 - DNA, 16 bp, synthetic construct
  source 1..16: mol_type = other DNA
cagtaggcagtttctc

SEQ ID NO: 754 - DNA, 16 bp, synthetic construct
  source 1..16: mol_type = other DNA
ttcagttagcagctaa

SEQ ID NO: 755 - DNA, 16 bp, synthetic construct
  source 1..16: mol_type = other DNA
ctgcaaagttaatagg

SEQ ID NO: 756 - DNA, 16 bp, synthetic construct
  source 1..16: mol_type = other DNA
gtttatcagtaaagtg

SEQ ID NO: 757 - DNA, 16 bp, synthetic construct
  source 1..16: mol_type = other DNA
ttaagagaaggtgcac

SEQ ID NO: 758 - DNA, 16 bp, synthetic construct
  source 1..16: mol_type = other DNA
gccaagctttgtgtca

SEQ ID NO: 759 - DNA, 16 bp, synthetic construct
  source 1..16: mol_type = other DNA
tctgtatagctgcatt

SEQ ID NO: 760 - DNA, 16 bp, synthetic construct
  source 1..16: mol_type = other DNA
cacatatgtgaagagc

SEQ ID NO: 761 - DNA, 16 bp, synthetic construct
  source 1..16: mol_type = other DNA
atagaactagaactcc

SEQ ID NO: 762 - DNA, 16 bp, synthetic construct
  source 1..16: mol_type = other DNA
gataatttggtgtcat

SEQ ID NO: 763 - DNA, 16 bp, synthetic construct
  source 1..16: mol_type = other DNA
ttaaggatcattgcag

SEQ ID NO: 764 - DNA, 16 bp, synthetic construct
  source 1..16: mol_type = other DNA
cataaggccgattcat

SEQ ID NO: 765 - DNA, 16 bp, synthetic construct
  source 1..16: mol_type = other DNA
ggaaaggatatttggc

SEQ ID NO: 766 - DNA, 16 bp, synthetic construct
  source 1..16: mol_type = other DNA
actctattgattggct

SEQ ID NO: 767 - DNA, 16 bp, synthetic construct
  source 1..16: mol_type = other DNA
tgattttgaccttacc

SEQ ID NO: 768 - DNA, 16 bp, synthetic construct
  source 1..16: mol_type = other DNA
tgactaaggagctaga

SEQ ID NO: 769 - DNA, 16 bp, synthetic construct
  source 1..16: mol_type = other DNA
attaagcttagtatat

SEQ ID NO: 770 - DNA, 16 bp, synthetic construct
  source 1..16: mol_type = other DNA
agctaactcaggctgt

SEQ ID NO: 771 - DNA, 16 bp, synthetic construct
  source 1..16: mol_type = other DNA
gcatacttattaagta

SEQ ID NO: 772 - DNA, 16 bp, synthetic construct
  source 1..16: mol_type = other DNA
tccattatccttactc

SEQ ID NO: 773 - DNA, 16 bp, synthetic construct
  source 1..16: mol_type = other DNA
tctacatggatccaac

SEQ ID NO: 774 - DNA, 16 bp, synthetic construct
  source 1..16: mol_type = other DNA
tgtaaaggctgggtga

SEQ ID NO: 775 - DNA, 16 bp, synthetic construct
  source 1..16: mol_type = other DNA
tatgacaactggaggt

SEQ ID NO: 776 - DNA, 16 bp, synthetic construct
  source 1..16: mol_type = other DNA
gttgataaaatagggt

SEQ ID NO: 777 - DNA, 16 bp, synthetic construct
  source 1..16: mol_type = other DNA
aaggagtagtggagcc

SEQ ID NO: 778 - DNA, 16 bp, synthetic construct
  source 1..16: mol_type = other DNA
gttatcagaaacttat

SEQ ID NO: 779 - DNA, 16 bp, synthetic construct
  source 1..16: mol_type = other DNA
ttatagactgggtagg

SEQ ID NO: 780 - DNA, 16 bp, synthetic construct
  source 1..16: mol_type = other DNA
gtttagcaatttagca

SEQ ID NO: 781 - DNA, 16 bp, synthetic construct
  source 1..16: mol_type = other DNA
atttagaaactgctcc

SEQ ID NO: 782 - DNA, 16 bp, synthetic construct
  source 1..16: mol_type = other DNA
gcttagtaccaagaca

SEQ ID NO: 783 - DNA, 16 bp, synthetic construct
  source 1..16: mol_type = other DNA
ccttttaactaccctc

SEQ ID NO: 784 - DNA, 16 bp, synthetic construct
  source 1..16: mol_type = other DNA
aggctaaaatggtcat

SEQ ID NO: 785 - DNA, 16 bp, synthetic construct
  source 1..16: mol_type = other DNA
ctaaaactgaaggtct

SEQ ID NO: 786 - DNA, 16 bp, synthetic construct
  source 1..16: mol_type = other DNA
taggaacattccctct

SEQ ID NO: 787 - DNA, 16 bp, synthetic construct
  source 1..16: mol_type = other DNA
tctaaattattgcctg

SEQ ID NO: 788 - DNA, 16 bp, synthetic construct
  source 1..16: mol_type = other DNA
acttcatagtggactt

SEQ ID NO: 789 - DNA, 16 bp, synthetic construct
  source 1..16: mol_type = other DNA
tgtgtagtcctaggga

SEQ ID NO: 790 - DNA, 16 bp, synthetic construct
  source 1..16: mol_type = other DNA
ggatttctaggatgat

SEQ ID NO: 791 - DNA, 16 bp, synthetic construct
  source 1..16: mol_type = other DNA
ttcaccaacgactcca

SEQ ID NO: 792 - DNA, 16 bp, synthetic construct
  source 1..16: mol_type = other DNA
cataagtagtctgcct

SEQ ID NO: 793 - DNA, 16 bp, synthetic construct
  source 1..16: mol_type = other DNA
cctccacaccgcgctt

SEQ ID NO: 794 - DNA, 16 bp, synthetic construct
  source 1..16: mol_type = other DNA
atacgcatgcgcagtg

SEQ ID NO: 795 - DNA, 16 bp, synthetic construct
  source 1..16: mol_type = other DNA
cctgatttagagagcg

SEQ ID NO: 796 - DNA, 16 bp, synthetic construct
  source 1..16: mol_type = other DNA
gcattattcaccacga

SEQ ID NO: 797 - DNA, 16 bp, synthetic construct
  source 1..16: mol_type = other DNA
ctgagaagatcggctg

SEQ ID NO: 798 - DNA, 16 bp, synthetic construct
  source 1..16: mol_type = other DNA
ggatgttgacctcaaa

SEQ ID NO: 799 - DNA, 16 bp, synthetic construct
  source 1..16: mol_type = other DNA
tccatcatcgatggaa

SEQ ID NO: 800 - DNA, 16 bp, synthetic construct
  source 1..16: mol_type = other DNA
cgtggccgcacactga

SEQ ID NO: 801 - DNA, 16 bp, synthetic construct
  source 1..16: mol_type = other DNA
gacctctgtgaaagcc

SEQ ID NO: 802 - DNA, 16 bp, synthetic construct
  source 1..16: mol_type = other DNA
ttcacaaaaactgggc

SEQ ID NO: 803 - DNA, 16 bp, synthetic construct
  source 1..16: mol_type = other DNA
tctgtctccaatacag

SEQ ID NO: 804 - DNA, 16 bp, synthetic construct
  source 1..16: mol_type = other DNA
agtattccatctatca

SEQ ID NO: 805 - DNA, 16 bp, synthetic construct
  source 1..16: mol_type = other DNA
aaatcgctgaggcgcg

SEQ ID NO: 806 - DNA, 16 bp, synthetic construct
  source 1..16: mol_type = other DNA
ggccaaccactgcttc

SEQ ID NO: 807 - DNA, 16 bp, synthetic construct
  source 1..16: mol_type = other DNA
atgcatacatctctgg

SEQ ID NO: 808 - DNA, 16 bp, synthetic construct
  source 1..16: mol_type = other DNA
aagctttgcagcattg

SEQ ID NO: 809 - DNA, 16 bp, synthetic construct
  source 1..16: mol_type = other DNA
agacaggtaattaatc

SEQ ID NO: 810 - DNA, 16 bp, synthetic construct
  source 1..16: mol_type = other DNA
cttttagggaggtagc

SEQ ID NO: 811 - DNA, 16 bp, synthetic construct
  source 1..16: mol_type = other DNA
gctacttgaacagtct

SEQ ID NO: 812 - DNA, 16 bp, synthetic construct
  source 1..16: mol_type = other DNA
ttctgtggcatggcta

SEQ ID NO: 813 - DNA, 16 bp, synthetic construct
  source 1..16: mol_type = other DNA
acttgatctcttagct

SEQ ID NO: 814 - DNA, 16 bp, synthetic construct
  source 1..16: mol_type = other DNA
ggctagggaaatcttt

SEQ ID NO: 815 - DNA, 16 bp, synthetic construct
  source 1..16: mol_type = other DNA
agtccagaatagagtt

SEQ ID NO: 816 - DNA, 16 bp, synthetic construct
  source 1..16: mol_type = other DNA
atagagggtccacttt

SEQ ID NO: 817 - DNA, 16 bp, synthetic construct
  source 1..16: mol_type = other DNA
aaaatagagtcggtca

SEQ ID NO: 818 - DNA, 16 bp, synthetic construct
  source 1..16: mol_type = other DNA
gagcctaaaattgtct

SEQ ID NO: 819 - DNA, 16 bp, synthetic construct
  source 1..16: mol_type = other DNA
ttcttatgtaatagcc

SEQ ID NO: 820 - DNA, 16 bp, synthetic construct
  source 1..16: mol_type = other DNA
tgatgtagtgggagtc

SEQ ID NO: 821 - DNA, 16 bp, synthetic construct
  source 1..16: mol_type = other DNA
ctacaagaggttattt

SEQ ID NO: 822 - DNA, 16 bp, synthetic construct
  source 1..16: mol_type = other DNA
atatacagactaaggg

SEQ ID NO: 823 - DNA, 16 bp, synthetic construct
  source 1..16: mol_type = other DNA
aagttattatccccac

SEQ ID NO: 824 - DNA, 16 bp, synthetic construct
  source 1..16: mol_type = other DNA
aactaaacatgacagc

SEQ ID NO: 825 - DNA, 16 bp, synthetic construct
  source 1..16: mol_type = other DNA
ttttaatacgacttcc

SEQ ID NO: 826 - DNA, 16 bp, synthetic construct
  source 1..16: mol_type = other DNA
ataagagccaaactgc

SEQ ID NO: 827 - DNA, 16 bp, synthetic construct
  source 1..16: mol_type = other DNA
cataagttaccagagc

SEQ ID NO: 828 - DNA, 16 bp, synthetic construct
  source 1..16: mol_type = other DNA
ctgtaggctaaaccct

SEQ ID NO: 829 - DNA, 16 bp, synthetic construct
  source 1..16: mol_type = other DNA
gctctaatgtttcttg

SEQ ID NO: 830 - DNA, 16 bp, synthetic construct
  source 1..16: mol_type = other DNA
gtaaactgtatgcctc

SEQ ID NO: 831 - DNA, 16 bp, synthetic construct
  source 1..16: mol_type = other DNA
tacagtaggcagtttc

SEQ ID NO: 832 - DNA, 16 bp, synthetic construct
  source 1..16: mol_type = other DNA
cttcagttagcagcta

SEQ ID NO: 833 - DNA, 16 bp, synthetic construct
  source 1..16: mol_type = other DNA
actacattaacaccaa

SEQ ID NO: 834 - DNA, 16 bp, synthetic construct
  source 1..16: mol_type = other DNA
tgcaagtttatcagta

SEQ ID NO: 835 - DNA, 16 bp, synthetic construct
  source 1..16: mol_type = other DNA
cttaagagaaggtgca

SEQ ID NO: 836 - DNA, 16 bp, synthetic construct
  source 1..16: mol_type = other DNA
cttaacaaacctccac

SEQ ID NO: 837 - DNA, 16 bp, synthetic construct
  source 1..16: mol_type = other DNA
attatatgaggtctgt

SEQ ID NO: 838 - DNA, 16 bp, synthetic construct
  source 1..16: mol_type = other DNA
tcacatatgtgaagag

SEQ ID NO: 839 - DNA, 16 bp, synthetic construct
  source 1..16: mol_type = other DNA
catagaactagaactc

SEQ ID NO: 840 - DNA, 16 bp, synthetic construct
  source 1..16: mol_type = other DNA
tgataatttggtgtca

SEQ ID NO: 841 - DNA, 16 bp, synthetic construct
  source 1..16: mol_type = other DNA
cttaaggatcattgca

SEQ ID NO: 842 - DNA, 16 bp, synthetic construct
  source 1..16: mol_type = other DNA
gtaatcttgaggcagg

SEQ ID NO: 843 - DNA, 16 bp, synthetic construct
  source 1..16: mol_type = other DNA
tattatgaggatctgg

SEQ ID NO: 844 - DNA, 16 bp, synthetic construct
  source 1..16: mol_type = other DNA
agcagaattgtgaacg

SEQ ID NO: 845 - DNA, 16 bp, synthetic construct
  source 1..16: mol_type = other DNA
catacccattctaact

SEQ ID NO: 846 - DNA, 16 bp, synthetic construct
  source 1..16: mol_type = other DNA
ttgactaaggagctag

SEQ ID NO: 847 - DNA, 16 bp, synthetic construct
  source 1..16: mol_type = other DNA
cattaagcttagtata

SEQ ID NO: 848 - DNA, 16 bp, synthetic construct
  source 1..16: mol_type = other DNA
catagctaactcaggc

SEQ ID NO: 849 - DNA, 16 bp, synthetic construct
  source 1..16: mol_type = other DNA
cttacatattgcatac

SEQ ID NO: 850 - DNA, 16 bp, synthetic construct
  source 1..16: mol_type = other DNA
ctaagttagcccccag

SEQ ID NO: 851 - DNA, 16 bp, synthetic construct
  source 1..16: mol_type = other DNA
atctacatggatccaa

SEQ ID NO: 852 - DNA, 16 bp, synthetic construct
  source 1..16: mol_type = other DNA
gaatgtaaaggctggg

SEQ ID NO: 853 - DNA, 16 bp, synthetic construct
  source 1..16: mol_type = other DNA
ggagtatgacaactgg

SEQ ID NO: 854 - DNA, 16 bp, synthetic construct
  source 1..16: mol_type = other DNA
cgtttaaatcagagca

SEQ ID NO: 855 - DNA, 16 bp, synthetic construct
  source 1..16: mol_type = other DNA
taaggagtagtggagc

SEQ ID NO: 856 - DNA, 16 bp, synthetic construct
  source 1..16: mol_type = other DNA
attaatgccaccctac

SEQ ID NO: 857 - DNA, 16 bp, synthetic construct
  source 1..16: mol_type = other DNA
ctttttatagactggg

SEQ ID NO: 858 - DNA, 16 bp, synthetic construct
  source 1..16: mol_type = other DNA
aggtttagcaatttag

SEQ ID NO: 859 - DNA, 16 bp, synthetic construct
  source 1..16: mol_type = other DNA
atagttatcttctcac

SEQ ID NO: 860 - DNA, 16 bp, synthetic construct
  source 1..16: mol_type = other DNA
tattaatatgacttgc

SEQ ID NO: 861 - DNA, 16 bp, synthetic construct
  source 1..16: mol_type = other DNA
gccttttaactaccct

SEQ ID NO: 862 - DNA, 16 bp, synthetic construct
  source 1..16: mol_type = other DNA
taggctaaaatggtca

SEQ ID NO: 863 - DNA, 16 bp, synthetic construct
  source 1..16: mol_type = other DNA
gatctaaaactgaagg

SEQ ID NO: 864 - DNA, 16 bp, synthetic construct
  source 1..16: mol_type = other DNA
aatttcatacagttcg

SEQ ID NO: 865 - DNA, 16 bp, synthetic construct
  source 1..16: mol_type = other DNA
gtctaaattattgcct

SEQ ID NO: 866 - DNA, 16 bp, synthetic construct
  source 1..16: mol_type = other DNA
cataacttcatagtgg

SEQ ID NO: 867 - DNA, 16 bp, synthetic construct
  source 1..16: mol_type = other DNA
ttgtgtagtcctaggg

SEQ ID NO: 868 - DNA, 16 bp, synthetic construct
  source 1..16: mol_type = other DNA
gaaggatttctaggat

SEQ ID NO: 869 - DNA, 16 bp, synthetic construct
  source 1..16: mol_type = other DNA
cttcaccaacgactcc

SEQ ID NO: 870 - DNA, 16 bp, synthetic construct
  source 1..16: mol_type = other DNA
tcataagtagtctgcc

SEQ ID NO: 871 - DNA, 16 bp, synthetic construct
  source 1..16: mol_type = other DNA
tcctccacaccgcgct

SEQ ID NO: 872 - DNA, 16 bp, synthetic construct
  source 1..16: mol_type = other DNA
catacgcatgcgcagt

SEQ ID NO: 873 - DNA, 16 bp, synthetic construct
  source 1..16: mol_type = other DNA
acctgatttagagagc

SEQ ID NO: 874 - DNA, 16 bp, synthetic construct
  source 1..16: mol_type = other DNA
agcattattcaccacg

SEQ ID NO: 875 - DNA, 16 bp, synthetic construct
  source 1..16: mol_type = other DNA
gctgagaagatcggct

SEQ ID NO: 876 - DNA, 16 bp, synthetic construct
  source 1..16: mol_type = other DNA
aggatgttgacctcaa

SEQ ID NO: 877 - DNA, 16 bp, synthetic construct
  source 1..16: mol_type = other DNA
ctccatcatcgatgga

SEQ ID NO: 878 - DNA, 16 bp, synthetic construct
  source 1..16: mol_type = other DNA
gtaaggaatcccttcg

SEQ ID NO: 879 - DNA, 16 bp, synthetic construct
  source 1..16: mol_type = other DNA
agacctctgtgaaagc

SEQ ID NO: 880 - DNA, 16 bp, synthetic construct
  source 1..16: mol_type = other DNA
acccagtattcacaaa

SEQ ID NO: 881 - DNA, 16 bp, synthetic construct
  source 1..16: mol_type = other DNA
atctgtctccaataca

SEQ ID NO: 882 - DNA, 16 bp, synthetic construct
  source 1..16: mol_type = other DNA
aagtattccatctatc

SEQ ID NO: 883 - DNA, 16 bp, synthetic construct
  source 1..16: mol_type = other DNA
aaaatcgctgaggcgc

SEQ ID NO: 884 - DNA, 16 bp, synthetic construct
  source 1..16: mol_type = other DNA
tggccaaccactgctt

SEQ ID NO: 885 - DNA, 16 bp, synthetic construct
  source 1..16: mol_type = other DNA
catgcatacatctctg

SEQ ID NO: 886 - DNA, 16 bp, synthetic construct
  source 1..16: mol_type = other DNA
aataaagctttgcagc

SEQ ID NO: 887 - DNA, 16 bp, synthetic construct
  source 1..16: mol_type = other DNA
caggaagacaggtaat

SEQ ID NO: 888 - DNA, 16 bp, synthetic construct
  source 1..16: mol_type = other DNA
acttttagggaggtag

SEQ ID NO: 889 - DNA, 16 bp, synthetic construct
  source 1..16: mol_type = other DNA
tgctacttgaacagtc

SEQ ID NO: 890 - DNA, 16 bp, synthetic construct
  source 1..16: mol_type = other DNA
tattctgtggcatggc

SEQ ID NO: 891 - DNA, 16 bp, synthetic construct
  source 1..16: mol_type = other DNA
aacttgatctcttagc

SEQ ID NO: 892 - DNA, 16 bp, synthetic construct
  source 1..16: mol_type = other DNA
aggctagggaaatctt

SEQ ID NO: 893 - DNA, 16 bp, synthetic construct
  source 1..16: mol_type = other DNA
aagtccagaatagagt

SEQ ID NO: 894 - DNA, 16 bp, synthetic construct
  source 1..16: mol_type = other DNA
tatagagggtccactt

SEQ ID NO: 895 - DNA, 16 bp, synthetic construct
  source 1..16: mol_type = other DNA
taaaatagagtcggtc

SEQ ID NO: 896 - DNA, 16 bp, synthetic construct
  source 1..16: mol_type = other DNA
tgagcctaaaattgtc

SEQ ID NO: 897 - DNA, 16 bp, synthetic construct
  source 1..16: mol_type = other DNA
gtttcttatgtaatag

SEQ ID NO: 898 - DNA, 16 bp, synthetic construct
  source 1..16: mol_type = other DNA
ttgatgtagtgggagt

SEQ ID NO: 899 - DNA, 16 bp, synthetic construct
  source 1..16: mol_type = other DNA
actacaagaggttatt

SEQ ID NO: 900 - DNA, 16 bp, synthetic construct
  source 1..16: mol_type = other DNA
catatacagactaagg

SEQ ID NO: 901 - DNA, 16 bp, synthetic construct
  source 1..16: mol_type = other DNA
taagttattatcccca

SEQ ID NO: 902 - DNA, 16 bp, synthetic construct
  source 1..16: mol_type = other DNA
ctctaagtgtaagaga

SEQ ID NO: 903 - DNA, 16 bp, synthetic construct
  source 1..16: mol_type = other DNA
tttttaatacgacttc

SEQ ID NO: 904 - DNA, 16 bp, synthetic construct
  source 1..16: mol_type = other DNA
cataagagccaaactg

SEQ ID NO: 905 - DNA, 16 bp, synthetic construct
  source 1..16: mol_type = other DNA
gcataagttaccagag

SEQ ID NO: 906 - DNA, 16 bp, synthetic construct
  source 1..16: mol_type = other DNA
gtatttcgctactgta

SEQ ID NO: 907 - DNA, 16 bp, synthetic construct
  source 1..16: mol_type = other DNA
cctaagataaaattgc

SEQ ID NO: 908 - DNA, 16 bp, synthetic construct
  source 1..16: mol_type = other DNA
tggtaaactgtatgcc

SEQ ID NO: 909 - DNA, 16 bp, synthetic construct
  source 1..16: mol_type = other DNA
gtacagtaggcagttt

SEQ ID NO: 910 - DNA, 16 bp, synthetic construct
  source 1..16: mol_type = other DNA
aactacttcagttagc

SEQ ID NO: 911 - DNA, 16 bp, synthetic construct
  source 1..16: mol_type = other DNA
gaagactacattaaca

SEQ ID NO: 912 - DNA, 16 bp, synthetic construct
  source 1..16: mol_type = other DNA
aaatttcagtacccag

SEQ ID NO: 913 - DNA, 16 bp, synthetic construct
  source 1..16: mol_type = other DNA
tcttaagagaaggtgc

SEQ ID NO: 914 - DNA, 16 bp, synthetic construct
  source 1..16: mol_type = other DNA
ccttaacaaacctcca

SEQ ID NO: 915 - DNA, 16 bp, synthetic construct
  source 1..16: mol_type = other DNA
caattatatgaggtct

SEQ ID NO: 916 - DNA, 16 bp, synthetic construct
  source 1..16: mol_type = other DNA
gccaattcacatatgt

SEQ ID NO: 917 - DNA, 16 bp, synthetic construct
  source 1..16: mol_type = other DNA
tatatgttgatgttac

SEQ ID NO: 918 - DNA, 16 bp, synthetic construct
  source 1..16: mol_type = other DNA
atgataatttggtgtc

SEQ ID NO: 919 - DNA, 16 bp, synthetic construct
  source 1..16: mol_type = other DNA
tcttaaggatcattgc

SEQ ID NO: 920 - DNA, 16 bp, synthetic construct
  source 1..16: mol_type = other DNA
ttgtaatcttgaggca

SEQ ID NO: 921 - DNA, 16 bp, synthetic construct
  source 1..16: mol_type = other DNA
ttattatgaggatctg

SEQ ID NO: 922 - DNA, 16 bp, synthetic construct
  source 1..16: mol_type = other DNA
aagcagaattgtgaac

SEQ ID NO: 923 - DNA, 16 bp, synthetic construct
  source 1..16: mol_type = other DNA
cataccacatacccat

SEQ ID NO: 924 - DNA, 16 bp, synthetic construct
  source 1..16: mol_type = other DNA
cttgactaaggagcta

SEQ ID NO: 925 - DNA, 16 bp, synthetic construct
  source 1..16: mol_type = other DNA
tcattaagcttagtat

SEQ ID NO: 926 - DNA, 16 bp, synthetic construct
  source 1..16: mol_type = other DNA
acatagctaactcagg

SEQ ID NO: 927 - DNA, 16 bp, synthetic construct
  source 1..16: mol_type = other DNA
gtactatagtatttac

SEQ ID NO: 928 - DNA, 16 bp, synthetic construct
  source 1..16: mol_type = other DNA
tctaagttagccccca

SEQ ID NO: 929 - DNA, 16 bp, synthetic construct
  source 1..16: mol_type = other DNA
catctacatggatcca

SEQ ID NO: 930 - DNA, 16 bp, synthetic construct
  source 1..16: mol_type = other DNA
ttaagatgtccaggca

SEQ ID NO: 931 - DNA, 16 bp, synthetic construct
  source 1..16: mol_type = other DNA
aaggagtatgacaact

SEQ ID NO: 932 - DNA, 16 bp, synthetic construct
  source 1..16: mol_type = other DNA
cataaagctggattgt

SEQ ID NO: 933 - DNA, 16 bp, synthetic construct
  source 1..16: mol_type = other DNA
gtaaggagtagtggag

SEQ ID NO: 934 - DNA, 16 bp, synthetic construct
  source 1..16: mol_type = other DNA
cattaatgccacccta

SEQ ID NO: 935 - DNA, 16 bp, synthetic construct
  source 1..16: mol_type = other DNA
agtagatttggtagag

SEQ ID NO: 936 - DNA, 16 bp, synthetic construct
  source 1..16: mol_type = other DNA
gcttatcgagtttagc

SEQ ID NO: 937 - DNA, 16 bp, synthetic construct
  source 1..16: mol_type = other DNA
gtatagttatcttctc

SEQ ID NO: 938 - DNA, 16 bp, synthetic construct
  source 1..16: mol_type = other DNA
atactattctccaact

SEQ ID NO: 939 - DNA, 16 bp, synthetic construct
  source 1..16: mol_type = other DNA
ataagaagagagctca

SEQ ID NO: 940 - DNA, 16 bp, synthetic construct
  source 1..16: mol_type = other DNA
gtttagctgataggct

SEQ ID NO: 941 - DNA, 16 bp, synthetic construct
  source 1..16: mol_type = other DNA
tatgagtaaagatcta

SEQ ID NO: 942 - DNA, 16 bp, synthetic construct
  source 1..16: mol_type = other DNA
gtaatcagttttcctc

SEQ ID NO: 943 - DNA, 16 bp, synthetic construct
  source 1..16: mol_type = other DNA
gtaaggtaaagtctaa

SEQ ID NO: 944 - DNA, 16 bp, synthetic construct
  source 1..16: mol_type = other DNA
acataacttcatagtg

SEQ ID NO: 945 - DNA, 16 bp, synthetic construct
  source 1..16: mol_type = other DNA
cttgtgtagtcctagg

SEQ ID NO: 946 - DNA, 16 bp, synthetic construct
  source 1..16: mol_type = other DNA
atggtgatcagaagca

SEQ ID NO: 947 - DNA, 16 bp, synthetic construct
  source 1..16: mol_type = other DNA
acttcaccaacgactc

SEQ ID NO: 948 - DNA, 16 bp, synthetic construct
  source 1..16: mol_type = other DNA
ttcataagtagtctgc

SEQ ID NO: 949 - DNA, 16 bp, synthetic construct
  source 1..16: mol_type = other DNA
ttcctccacaccgcgc

SEQ ID NO: 950 - DNA, 16 bp, synthetic construct
  source 1..16: mol_type = other DNA
acatacgcatgcgcag

SEQ ID NO: 951 - DNA, 16 bp, synthetic construct
  source 1..16: mol_type = other DNA
cacctgatttagagag

SEQ ID NO: 952 - DNA, 16 bp, synthetic construct
  source 1..16: mol_type = other DNA
cccagcattattcacc

SEQ ID NO: 953 - DNA, 16 bp, synthetic construct
  source 1..16: mol_type = other DNA
tgctgagaagatcggc

SEQ ID NO: 954 - DNA, 16 bp, synthetic construct
  source 1..16: mol_type = other DNA
taggatgttgacctca

SEQ ID NO: 955 - DNA, 16 bp, synthetic construct
  source 1..16: mol_type = other DNA
tctccatcatcgatgg

SEQ ID NO: 956 - DNA, 16 bp, synthetic construct
  source 1..16: mol_type = other DNA
ggtaaggaatcccttc

SEQ ID NO: 957 - DNA, 16 bp, synthetic construct
  source 1..16: mol_type = other DNA
gtcagacctctgtgaa

SEQ ID NO: 958 - DNA, 16 bp, synthetic construct
  source 1..16: mol_type = other DNA
aacccagtattcacaa

SEQ ID NO: 959 - DNA, 16 bp, synthetic construct
  source 1..16: mol_type = other DNA
catctgtctccaatac

SEQ ID NO: 960 - DNA, 16 bp, synthetic construct
  source 1..16: mol_type = other DNA
taagtattccatctat

SEQ ID NO: 961 - DNA, 16 bp, synthetic construct
  source 1..16: mol_type = other DNA
taaaatcgctgaggcg

SEQ ID NO: 962 - DNA, 16 bp, synthetic construct
  source 1..16: mol_type = other DNA
gtggccaaccactgct

SEQ ID NO: 963 - DNA, 16 bp, synthetic construct
  source 1..16: mol_type = other DNA
tcatgcatacatctct

SEQ ID NO: 964 - DNA, 16 bp, synthetic construct
  source 1..16: mol_type = other DNA
atattatcaggactga

SEQ ID NO: 965 - DNA, 16 bp, synthetic construct
  source 1..16: mol_type = other DNA
cgtaaatattcttgag

SEQ ID NO: 966 - DNA, 16 bp, synthetic construct
  source 1..16: mol_type = other DNA
tacttttagggaggta

SEQ ID NO: 967 - DNA, 16 bp, synthetic construct
  source 1..16: mol_type = other DNA
atgctacttgaacagt

SEQ ID NO: 968 - DNA, 16 bp, synthetic construct
  source 1..16: mol_type = other DNA
atattctgtggcatgg

SEQ ID NO: 969 - DNA, 16 bp, synthetic construct
  source 1..16: mol_type = other DNA
ctgctgaaacttgatc

SEQ ID NO: 970 - DNA, 16 bp, synthetic construct
  source 1..16: mol_type = other DNA
gaggctagggaaatct

SEQ ID NO: 971 - DNA, 16 bp, synthetic construct
  source 1..16: mol_type = other DNA
gtaataaagtccagaa

SEQ ID NO: 972 - DNA, 16 bp, synthetic construct
  source 1..16: mol_type = other DNA
atatagagggtccact

SEQ ID NO: 973 - DNA, 16 bp, synthetic construct
  source 1..16: mol_type = other DNA
ttaaaatagagtcggt

SEQ ID NO: 974 - DNA, 16 bp, synthetic construct
  source 1..16: mol_type = other DNA
ttgagcctaaaattgt

SEQ ID NO: 975 - DNA, 16 bp, synthetic construct
  source 1..16: mol_type = other DNA
ggtccattgtttctta

SEQ ID NO: 976 - DNA, 16 bp, synthetic construct
  source 1..16: mol_type = other DNA
cttgatgtagtgggag

SEQ ID NO: 977 - DNA, 16 bp, synthetic construct
  source 1..16: mol_type = other DNA
aactacaagaggttat

SEQ ID NO: 978 - DNA, 16 bp, synthetic construct
  source 1..16: mol_type = other DNA
acatatacagactaag

SEQ ID NO: 979 - DNA, 16 bp, synthetic construct
  source 1..16: mol_type = other DNA
ctaagttattatcccc

SEQ ID NO: 980 - DNA, 16 bp, synthetic construct
  source 1..16: mol_type = other DNA
gtatagtattcttcac

SEQ ID NO: 981 - DNA, 16 bp, synthetic construct
  source 1..16: mol_type = other DNA
catttttaatacgact

SEQ ID NO: 982 - DNA, 16 bp, synthetic construct
  source 1..16: mol_type = other DNA
gcataagagccaaact

SEQ ID NO: 983 - DNA, 16 bp, synthetic construct
  source 1..16: mol_type = other DNA
agcataagttaccaga

SEQ ID NO: 984 - DNA, 16 bp, synthetic construct
  source 1..16: mol_type = other DNA
ttgtatttcgctactg

SEQ ID NO: 985 - DNA, 16 bp, synthetic construct
  source 1..16: mol_type = other DNA
cctaaattcaaagacc

SEQ ID NO: 986 - DNA, 16 bp, synthetic construct
  source 1..16: mol_type = other DNA
gtaatggtaaactgta

SEQ ID NO: 987 - DNA, 16 bp, synthetic construct
  source 1..16: mol_type = other DNA
tgagattacccctggc

SEQ ID NO: 988 - DNA, 16 bp, synthetic construct
  source 1..16: mol_type = other DNA
cataactacttcagtt

SEQ ID NO: 989 - DNA, 16 bp, synthetic construct
  source 1..16: mol_type = other DNA
cttagttcattgtgat

SEQ ID NO: 990 - DNA, 16 bp, synthetic construct
  source 1..16: mol_type = other DNA
ctaaatttcagtaccc

SEQ ID NO: 991 - DNA, 16 bp, synthetic construct
  source 1..16: mol_type = other DNA
atcttaagagaaggtg

SEQ ID NO: 992 - DNA, 16 bp, synthetic construct
  source 1..16: mol_type = other DNA
cccttaacaaacctcc

SEQ ID NO: 993 - DNA, 16 bp, synthetic construct
  source 1..16: mol_type = other DNA
aaccaattatatgagg

SEQ ID NO: 994 - DNA, 16 bp, synthetic construct
  source 1..16: mol_type = other DNA
gtgtagtttggtgggc

SEQ ID NO: 995 - DNA, 16 bp, synthetic construct
  source 1..16: mol_type = other DNA
cctatttgtaatattg

SEQ ID NO: 996 - DNA, 16 bp, synthetic construct
  source 1..16: mol_type = other DNA
ttatgataatttggtg

SEQ ID NO: 997 - DNA, 16 bp, synthetic construct
  source 1..16: mol_type = other DNA
atcttaaggatcattg

SEQ ID NO: 998 - DNA, 16 bp, synthetic construct
  source 1..16: mol_type = other DNA
gcattgtaatcttgag

SEQ ID NO: 999 - DNA, 16 bp, synthetic construct
  source 1..16: mol_type = other DNA
tttattatgaggatct

SEQ ID NO: 1000 - DNA, 16 bp, synthetic construct
  source 1..16: mol_type = other DNA
ttaagcagaattgtga

SEQ ID NO: 1001 - DNA, 16 bp, synthetic construct
  source 1..16: mol_type = other DNA
atcataccacataccc

SEQ ID NO: 1002 - DNA, 16 bp, synthetic construct
  source 1..16: mol_type = other DNA
gcagaaattcaccttg

SEQ ID NO: 1003 - DNA, 16 bp, synthetic construct
  source 1..16: mol_type = other DNA
gaatcattaagcttag

SEQ ID NO: 1004 - DNA, 16 bp, synthetic construct
  source 1..16: mol_type = other DNA
ccacatagctaactca

SEQ ID NO: 1005 - DNA, 16 bp, synthetic construct
  source 1..16: mol_type = other DNA
caatagtactatagta

SEQ ID NO: 1006 - DNA, 16 bp, synthetic construct
  source 1..16: mol_type = other DNA
ctctaagttagccccc

SEQ ID NO: 1007 - DNA, 16 bp, synthetic construct
  source 1..16: mol_type = other DNA
aattactccgttctgc

SEQ ID NO: 1008 - DNA, 16 bp, synthetic construct
  source 1..16: mol_type = other DNA
attaagatgtccaggc

SEQ ID NO: 1009 - DNA, 16 bp, synthetic construct
  source 1..16: mol_type = other DNA
caaggagtatgacaac

SEQ ID NO: 1010 - DNA, 16 bp, synthetic construct
  source 1..16: mol_type = other DNA
tccataaagctggatt

SEQ ID NO: 1011 - DNA, 16 bp, synthetic construct
  source 1..16: mol_type = other DNA
tggtaaggagtagtgg

SEQ ID NO: 1012 - DNA, 16 bp, synthetic construct
  source 1..16: mol_type = other DNA
gcattaatgccaccct

SEQ ID NO: 1013 - DNA, 16 bp, synthetic construct
  source 1..16: mol_type = other DNA
cagtagatttggtaga

SEQ ID NO: 1014 - DNA, 16 bp, synthetic construct
  source 1..16: mol_type = other DNA
agcttatcgagtttag

SEQ ID NO: 1015 - DNA, 16 bp, synthetic construct
  source 1..16: mol_type = other DNA
agtatagttatcttct

SEQ ID NO: 1016 - DNA, 16 bp, synthetic construct
  source 1..16: mol_type = other DNA
gatactattctccaac

SEQ ID NO: 1017 - DNA, 16 bp, synthetic construct
  source 1..16: mol_type = other DNA
gataagaagagagctc

SEQ ID NO: 1018 - DNA, 16 bp, synthetic construct
  source 1..16: mol_type = other DNA
atattgtttagctgat

SEQ ID NO: 1019 - DNA, 16 bp, synthetic construct
  source 1..16: mol_type = other DNA
gatatgagtaaagatc

SEQ ID NO: 1020 - DNA, 16 bp, synthetic construct
  source 1..16: mol_type = other DNA
gagtaatcagttttcc

SEQ ID NO: 1021 - DNA, 16 bp, synthetic construct
  source 1..16: mol_type = other DNA
agtaaggtaaagtcta

SEQ ID NO: 1022 - DNA, 16 bp, synthetic construct
  source 1..16: mol_type = other DNA
tgacataacttcatag

SEQ ID NO: 1023 - DNA, 16 bp, synthetic construct
  source 1..16: mol_type = other DNA
ccttgtgtagtcctag

SEQ ID NO: 1024 - DNA, 16 bp, synthetic construct
  source 1..16: mol_type = other DNA
gatggtgatcagaagc

SEQ ID NO: 1025 - DNA, 16 bp, synthetic construct
  source 1..16: mol_type = other DNA
aacttcaccaacgact

SEQ ID NO: 1026 - DNA, 16 bp, synthetic construct
  source 1..16: mol_type = other DNA
attcataagtagtctg

SEQ ID NO: 1027 - DNA, 16 bp, synthetic construct
  source 1..16: mol_type = other DNA
tttcctccacaccgcg

SEQ ID NO: 1028 - DNA, 16 bp, synthetic construct
  source 1..16: mol_type = other DNA
cacatacgcatgcgca

SEQ ID NO: 1029 - DNA, 16 bp, synthetic construct
  source 1..16: mol_type = other DNA
tcacctgatttagaga

SEQ ID NO: 1030 - DNA, 16 bp, synthetic construct
  source 1..16: mol_type = other DNA
gtcccagcattattca

SEQ ID NO: 1031 - DNA, 16 bp, synthetic construct
  source 1..16: mol_type = other DNA
gtgctgagaagatcgg

SEQ ID NO: 1032 - DNA, 16 bp, synthetic construct
  source 1..16: mol_type = other DNA
ctaggatgttgacctc

SEQ ID NO: 1033 - DNA, 16 bp, synthetic construct
  source 1..16: mol_type = other DNA
ctctccatcatcgatg

SEQ ID NO: 1034 - DNA, 16 bp, synthetic construct
  source 1..16: mol_type = other DNA
aggtaaggaatccctt

SEQ ID NO: 1035 - DNA, 16 bp, synthetic construct
  source 1..16: mol_type = other DNA
tgtcagacctctgtga

SEQ ID NO: 1036 - DNA, 16 bp, synthetic construct
  source 1..16: mol_type = other DNA
gaacccagtattcaca

SEQ ID NO: 1037 - DNA, 16 bp, synthetic construct
  source 1..16: mol_type = other DNA
cgacttcatctgtctc

SEQ ID NO: 1038 - DNA, 16 bp, synthetic construct
  source 1..16: mol_type = other DNA
gtaagtattccatcta

SEQ ID NO: 1039 - DNA, 16 bp, synthetic construct
  source 1..16: mol_type = other DNA
ttaaaatcgctgaggc

SEQ ID NO: 1040 - DNA, 16 bp, synthetic construct
  source 1..16: mol_type = other DNA
tgtggccaaccactgc

SEQ ID NO: 1041 - DNA, 16 bp, synthetic construct
  source 1..16: mol_type = other DNA
atcatgcatacatctc

SEQ ID NO: 1042 - DNA, 16 bp, synthetic construct
  source 1..16: mol_type = other DNA
gtgccaaaccaatgtt

SEQ ID NO: 1043 - DNA, 16 bp, synthetic construct
  source 1..16: mol_type = other DNA
cctatgaaaaactacg

SEQ ID NO: 1044 - DNA, 16 bp, synthetic construct
  source 1..16: mol_type = other DNA
gtatttacttttaggg

SEQ ID NO: 1045 - DNA, 16 bp, synthetic construct
  source 1..16: mol_type = other DNA
aatgctacttgaacag

SEQ ID NO: 1046 - DNA, 16 bp, synthetic construct
  source 1..16: mol_type = other DNA
gatattctgtggcatg

SEQ ID NO: 1047 - DNA, 16 bp, synthetic construct
  source 1..16: mol_type = other DNA
cctgctgaaacttgat

SEQ ID NO: 1048 - DNA, 16 bp, synthetic construct
  source 1..16: mol_type = other DNA
agaggctagggaaatc

SEQ ID NO: 1049 - DNA, 16 bp, synthetic construct
  source 1..16: mol_type = other DNA
agtaataaagtccaga

SEQ ID NO: 1050 - DNA, 16 bp, synthetic construct
  source 1..16: mol_type = other DNA
aatatagagggtccac

SEQ ID NO: 1051 - DNA, 16 bp, synthetic construct
  source 1..16: mol_type = other DNA
tttaaaatagagtcgg

SEQ ID NO: 1052 - DNA, 16 bp, synthetic construct
  source 1..16: mol_type = other DNA
tttgagcctaaaattg

SEQ ID NO: 1053 - DNA, 16 bp, synthetic construct
  source 1..16: mol_type = other DNA
gggtccattgtttctt

SEQ ID NO: 1054 - DNA, 16 bp, synthetic construct
  source 1..16: mol_type = other DNA
tcttgatgtagtggga

SEQ ID NO: 1055 - DNA, 16 bp, synthetic construct
  source 1..16: mol_type = other DNA
taactacaagaggtta

SEQ ID NO: 1056 - DNA, 16 bp, synthetic construct
  source 1..16: mol_type = other DNA
aactaacctgacacat

SEQ ID NO: 1057 - DNA, 16 bp, synthetic construct
  source 1..16: mol_type = other DNA
cctaagttattatccc

SEQ ID NO: 1058 - DNA, 16 bp, synthetic construct
  source 1..16: mol_type = other DNA
atacatcaactcctct

SEQ ID NO: 1059 - DNA, 16 bp, synthetic construct
  source 1..16: mol_type = other DNA
tcatttttaatacgac

SEQ ID NO: 1060 - DNA, 16 bp, synthetic construct
  source 1..16: mol_type = other DNA
tgcataagagccaaac

SEQ ID NO: 1061 - DNA, 16 bp, synthetic construct
  source 1..16: mol_type = other DNA
gagcataagttaccag

SEQ ID NO: 1062 - DNA, 16 bp, synthetic construct
  source 1..16: mol_type = other DNA
cttgaatgagtggtct

SEQ ID NO: 1063 - DNA, 16 bp, synthetic construct
  source 1..16: mol_type = other DNA
caatttactttcagcc

SEQ ID NO: 1064 - DNA, 16 bp, synthetic construct
  source 1..16: mol_type = other DNA
aactagtggtaatggt

SEQ ID NO: 1065 - DNA, 16 bp, synthetic construct
  source 1..16: mol_type = other DNA
gcaatgagattacccc

SEQ ID NO: 1066 - DNA, 16 bp, synthetic construct
  source 1..16: mol_type = other DNA
acataactacttcagt

SEQ ID NO: 1067 - DNA, 16 bp, synthetic construct
  source 1..16: mol_type = other DNA
gcttagttcattgtga

SEQ ID NO: 1068 - DNA, 16 bp, synthetic construct
  source 1..16: mol_type = other DNA
gggataaactgttctt

SEQ ID NO: 1069 - DNA, 16 bp, synthetic construct
  source 1..16: mol_type = other DNA
tatcttaagagaaggt

SEQ ID NO: 1070 - DNA, 16 bp, synthetic construct
  source 1..16: mol_type = other DNA
acccttaacaaacctc

SEQ ID NO: 1071 - DNA, 16 bp, synthetic construct
  source 1..16: mol_type = other DNA
taaccaattatatgag

SEQ ID NO: 1072 - DNA, 16 bp, synthetic construct
  source 1..16: mol_type = other DNA
ctccgtgtagtttggt

SEQ ID NO: 1073 - DNA, 16 bp, synthetic construct
  source 1..16: mol_type = other DNA
gaattcactatctccc

SEQ ID NO: 1074 - DNA, 16 bp, synthetic construct
  source 1..16: mol_type = other DNA
cttatgataatttggt

SEQ ID NO: 1075 - DNA, 16 bp, synthetic construct
  source 1..16: mol_type = other DNA
gatcttaaggatcatt

SEQ ID NO: 1076 - DNA, 16 bp, synthetic construct
  source 1..16: mol_type = other DNA
taaatccaaatcactc

SEQ ID NO: 1077 - DNA, 16 bp, synthetic construct
  source 1..16: mol_type = other DNA
ttttattatgaggatc

SEQ ID NO: 1078 - DNA, 16 bp, synthetic construct
  source 1..16: mol_type = other DNA
attaagcagaattgtg

SEQ ID NO: 1079 - DNA, 16 bp, synthetic construct
  source 1..16: mol_type = other DNA
ttatcataccacatac

SEQ ID NO: 1080 - DNA, 16 bp, synthetic construct
  source 1..16: mol_type = other DNA
caagagttcttgcaga

SEQ ID NO: 1081 - DNA, 16 bp, synthetic construct
  source 1..16: mol_type = other DNA
tcgaatcattaagctt

SEQ ID NO: 1082 - DNA, 16 bp, synthetic construct
  source 1..16: mol_type = other DNA
accacatagctaactc

SEQ ID NO: 1083 - DNA, 16 bp, synthetic construct
  source 1..16: mol_type = other DNA
gcaatagtactatagt

SEQ ID NO: 1084 - DNA, 16 bp, synthetic construct
  source 1..16: mol_type = other DNA
cctctaagttagcccc

SEQ ID NO: 1085 - DNA, 16 bp, synthetic construct
  source 1..16: mol_type = other DNA
aaattactccgttctg

SEQ ID NO: 1086 - DNA, 16 bp, synthetic construct
  source 1..16: mol_type = other DNA
tcaaattaagatgtcc

SEQ ID NO: 1087 - DNA, 16 bp, synthetic construct
  source 1..16: mol_type = other DNA
tgagaatttaagaggg

SEQ ID NO: 1088 - DNA, 16 bp, synthetic construct
  source 1..16: mol_type = other DNA
gtattccataaagctg

SEQ ID NO: 1089 - DNA, 16 bp, synthetic construct
  source 1..16: mol_type = other DNA
atggtaaggagtagtg

SEQ ID NO: 1090 - DNA, 16 bp, synthetic construct
  source 1..16: mol_type = other DNA
tgcattaatgccaccc

SEQ ID NO: 1091 - DNA, 16 bp, synthetic construct
  source 1..16: mol_type = other DNA
gacagtagatttggta

SEQ ID NO: 1092 - DNA, 16 bp, synthetic construct
  source 1..16: mol_type = other DNA
aagcttatcgagttta

SEQ ID NO: 1093 - DNA, 16 bp, synthetic construct
  source 1..16: mol_type = other DNA
tagtatagttatcttc

SEQ ID NO: 1094 - DNA, 16 bp, synthetic construct
  source 1..16: mol_type = other DNA
tgggatactattctcc

SEQ ID NO: 1095 - DNA, 16 bp, synthetic construct
  source 1..16: mol_type = other DNA
ggataagaagagagct

SEQ ID NO: 1096 - DNA, 16 bp, synthetic construct
  source 1..16: mol_type = other DNA
gatattgtttagctga

SEQ ID NO: 1097 - DNA, 16 bp, synthetic construct
  source 1..16: mol_type = other DNA
ctgatatgagtaaaga

SEQ ID NO: 1098 - DNA, 16 bp, synthetic construct
  source 1..16: mol_type = other DNA
gagagtaatcagtttt

SEQ ID NO: 1099 - DNA, 16 bp, synthetic construct
  source 1..16: mol_type = other DNA
aagtaaggtaaagtct

SEQ ID NO: 1100 - DNA, 16 bp, synthetic construct
  source 1..16: mol_type = other DNA
tttaactttcctccgt

SEQ ID NO: 1101 - DNA, 16 bp, synthetic construct
  source 1..16: mol_type = other DNA
tccttgtgtagtccta

SEQ ID NO: 1102 - DNA, 16 bp, synthetic construct
  source 1..16: mol_type = other DNA
tgatggtgatcagaag

SEQ ID NO: 1103 - DNA, 16 bp, synthetic construct
  source 1..16: mol_type = other DNA
aaacttcaccaacgac

SEQ ID NO: 1104 - DNA, 16 bp, synthetic construct
  source 1..16: mol_type = other DNA
aattcataagtagtct

SEQ ID NO: 1105 - DNA, 16 bp, synthetic construct
  source 1..16: mol_type = other DNA
gtttcctccacaccgc

SEQ ID NO: 1106 - DNA, 16 bp, synthetic construct
  source 1..16: mol_type = other DNA
ccacatacgcatgcgc

SEQ ID NO: 1107 - DNA, 16 bp, synthetic construct
  source 1..16: mol_type = other DNA
ttcacctgatttagag

SEQ ID NO: 1108 - DNA, 16 bp, synthetic construct
  source 1..16: mol_type = other DNA
tgtcccagcattattc

SEQ ID NO: 1109 - DNA, 16 bp, synthetic construct
  source 1..16: mol_type = other DNA
ggtgctgagaagatcg

SEQ ID NO: 1110 - DNA, 16 bp, synthetic construct
  source 1..16: mol_type = other DNA
cctaggatgttgacct

SEQ ID NO: 1111 - DNA, 16 bp, synthetic construct
  source 1..16: mol_type = other DNA
tctctccatcatcgat

SEQ ID NO: 1112 - DNA, 16 bp, synthetic construct
  source 1..16: mol_type = other DNA
gaggtaaggaatccct

SEQ ID NO: 1113 - DNA, 16 bp, synthetic construct
  source 1..16: mol_type = other DNA
atgtcagacctctgtg

SEQ ID NO: 1114 - DNA, 16 bp, synthetic construct
  source 1..16: mol_type = other DNA
tgaacccagtattcac

SEQ ID NO: 1115 - DNA, 16 bp, synthetic construct
  source 1..16: mol_type = other DNA
acgacttcatctgtct

SEQ ID NO: 1116 - DNA, 16 bp, synthetic construct
  source 1..16: mol_type = other DNA
ggtaagtattccatct

SEQ ID NO: 1117 - DNA, 16 bp, synthetic construct
  source 1..16: mol_type = other DNA
tttaaaatcgctgagg

SEQ ID NO: 1118 - DNA, 16 bp, synthetic construct
  source 1..16: mol_type = other DNA
ttgtggccaaccactg

SEQ ID NO: 1119 - DNA, 16 bp, synthetic construct
  source 1..16: mol_type = other DNA
tatcatgcatacatct

SEQ ID NO: 1120 - DNA, 16 bp, synthetic construct
  source 1..16: mol_type = other DNA
agtgccaaaccaatgt

SEQ ID NO: 1121 - DNA, 16 bp, synthetic construct
  source 1..16: mol_type = other DNA
cagacctatgaaaaac

SEQ ID NO: 1122 - DNA, 16 bp, synthetic construct
  source 1..16: mol_type = other DNA
gtgtaaataagttctc

SEQ ID NO: 1123 - DNA, 16 bp, synthetic construct
  source 1..16: mol_type = other DNA
gaatgctacttgaaca

SEQ ID NO: 1124 - DNA, 16 bp, synthetic construct
  source 1..16: mol_type = other DNA
tgatattctgtggcat

SEQ ID NO: 1125 - DNA, 16 bp, synthetic construct
  source 1..16: mol_type = other DNA
gcctgctgaaacttga

SEQ ID NO: 1126 - DNA, 16 bp, synthetic construct
  source 1..16: mol_type = other DNA
gggctaatgaaaaagg

SEQ ID NO: 1127 - DNA, 16 bp, synthetic construct
  source 1..16: mol_type = other DNA
tcaagtaataaagtcc

SEQ ID NO: 1128 - DNA, 16 bp, synthetic construct
  source 1..16: mol_type = other DNA
aaatatagagggtcca

SEQ ID NO: 1129 - DNA, 16 bp, synthetic construct
  source 1..16: mol_type = other DNA
atttaaaatagagtcg

SEQ ID NO: 1130 - DNA, 16 bp, synthetic construct
  source 1..16: mol_type = other DNA
taatttttgagcctaa

SEQ ID NO: 1131 - DNA, 16 bp, synthetic construct
  source 1..16: mol_type = other DNA
tgggtccattgtttct

SEQ ID NO: 1132 - DNA, 16 bp, synthetic construct
  source 1..16: mol_type = other DNA
gtcttgatgtagtggg

SEQ ID NO: 1133 - DNA, 16 bp, synthetic construct
  source 1..16: mol_type = other DNA
ataactacaagaggtt

SEQ ID NO: 1134 - DNA, 16 bp, synthetic construct
  source 1..16: mol_type = other DNA
taactaacctgacaca

SEQ ID NO: 1135 - DNA, 16 bp, synthetic construct
  source 1..16: mol_type = other DNA
ccctaagttattatcc

SEQ ID NO: 1136 - DNA, 16 bp, synthetic construct
  source 1..16: mol_type = other DNA
tatacatcaactcctc

SEQ ID NO: 1137 - DNA, 16 bp, synthetic construct
  source 1..16: mol_type = other DNA
agtcatttttaatacg

SEQ ID NO: 1138 - DNA, 16 bp, synthetic construct
  source 1..16: mol_type = other DNA
ttgcataagagccaaa

SEQ ID NO: 1139 - DNA, 16 bp, synthetic construct
  source 1..16: mol_type = other DNA
tagttggtagcttgct

SEQ ID NO: 1140 - DNA, 16 bp, synthetic construct
  source 1..16: mol_type = other DNA
accttgaatgagtggt

SEQ ID NO: 1141 - DNA, 16 bp, synthetic construct
  source 1..16: mol_type = other DNA
gcaatttactttcagc

SEQ ID NO: 1142 - DNA, 16 bp, synthetic construct
  source 1..16: mol_type = other DNA
tctaaactagtggtaa

SEQ ID NO: 1143 - DNA, 16 bp, synthetic construct
  source 1..16: mol_type = other DNA
ttgcaatgagattacc

SEQ ID NO: 1144 - DNA, 16 bp, synthetic construct
  source 1..16: mol_type = other DNA
gacataactacttcag

SEQ ID NO: 1145 - DNA, 16 bp, synthetic construct
  source 1..16: mol_type = other DNA
tttgttagagtgctta

SEQ ID NO: 1146 - DNA, 16 bp, synthetic construct
  source 1..16: mol_type = other DNA
cataaaggtgggataa

SEQ ID NO: 1147 - DNA, 16 bp, synthetic construct
  source 1..16: mol_type = other DNA
gtatcttaagagaagg

SEQ ID NO: 1148 - DNA, 16 bp, synthetic construct
  source 1..16: mol_type = other DNA
aaagatgtacactgac

SEQ ID NO: 1149 - DNA, 16 bp, synthetic construct
  source 1..16: mol_type = other DNA
ctaaccaattatatga

SEQ ID NO: 1150 - DNA, 16 bp, synthetic construct
  source 1..16: mol_type = other DNA
aatgtatgaggtctcc

SEQ ID NO: 1151 - DNA, 16 bp, synthetic construct
  source 1..16: mol_type = other DNA
gattgaattcactatc

SEQ ID NO: 1152 - DNA, 16 bp, synthetic construct
  source 1..16: mol_type = other DNA
ccttatgataatttgg

SEQ ID NO: 1153 - DNA, 16 bp, synthetic construct
  source 1..16: mol_type = other DNA
tgatcttaaggatcat

SEQ ID NO: 1154 - DNA, 16 bp, synthetic construct
  source 1..16: mol_type = other DNA
cattctaaactactat

SEQ ID NO: 1155 - DNA, 16 bp, synthetic construct
  source 1..16: mol_type = other DNA
gacaatggttgccact

SEQ ID NO: 1156 - DNA, 16 bp, synthetic construct
  source 1..16: mol_type = other DNA
gattaagcagaattgt

SEQ ID NO: 1157 - DNA, 16 bp, synthetic construct
  source 1..16: mol_type = other DNA
caatttatcataccac

SEQ ID NO: 1158 - DNA, 16 bp, synthetic construct
  source 1..16: mol_type = other DNA
acaagagttcttgcag

SEQ ID NO: 1159 - DNA, 16 bp, synthetic construct
  source 1..16: mol_type = other DNA
ttcgaatcattaagct

SEQ ID NO: 1160 - DNA, 16 bp, synthetic construct
  source 1..16: mol_type = other DNA
caccatgaaggactcc

SEQ ID NO: 1161 - DNA, 16 bp, synthetic construct
  source 1..16: mol_type = other DNA
tgcaatagtactatag

SEQ ID NO: 1162 - DNA, 16 bp, synthetic construct
  source 1..16: mol_type = other DNA
atttagcattgcctgt

SEQ ID NO: 1163 - DNA, 16 bp, synthetic construct
  source 1..16: mol_type = other DNA
taaattactccgttct

SEQ ID NO: 1164 - DNA, 16 bp, synthetic construct
  source 1..16: mol_type = other DNA
gtgcaagatgatgaca

SEQ ID NO: 1165 - DNA, 16 bp, synthetic construct
  source 1..16: mol_type = other DNA
gtatttgagattcacc

SEQ ID NO: 1166 - DNA, 16 bp, synthetic construct
  source 1..16: mol_type = other DNA
gctaagtatactttct

SEQ ID NO: 1167 - DNA, 16 bp, synthetic construct
  source 1..16: mol_type = other DNA
gatggtaaggagtagt

SEQ ID NO: 1168 - DNA, 16 bp, synthetic construct
  source 1..16: mol_type = other DNA
ctgcattaatgccacc

SEQ ID NO: 1169 - DNA, 16 bp, synthetic construct
  source 1..16: mol_type = other DNA
caaagtttgggcagag

SEQ ID NO: 1170 - DNA, 16 bp, synthetic construct
  source 1..16: mol_type = other DNA
aaaaagcttatcgagt

SEQ ID NO: 1171 - DNA, 16 bp, synthetic construct
  source 1..16: mol_type = other DNA
gttagtatagttatct

SEQ ID NO: 1172 - DNA, 16 bp, synthetic construct
  source 1..16: mol_type = other DNA
tttactgggatactat

SEQ ID NO: 1173 - DNA, 16 bp, synthetic construct
  source 1..16: mol_type = other DNA
agggaagatctggctg

SEQ ID NO: 1174 - DNA, 16 bp, synthetic construct
  source 1..16: mol_type = other DNA
agctattgtctttgat

SEQ ID NO: 1175 - DNA, 16 bp, synthetic construct
  source 1..16: mol_type = other DNA
ctcttatctgatatga

SEQ ID NO: 1176 - DNA, 16 bp, synthetic construct
  source 1..16: mol_type = other DNA
gcattaaaactctcat

SEQ ID NO: 1177 - DNA, 16 bp, synthetic construct
  source 1..16: mol_type = other DNA
caagtaaggtaaagtc

SEQ ID NO: 1178 - DNA, 16 bp, synthetic construct
  source 1..16: mol_type = other DNA
gtttaactttcctccg

SEQ ID NO: 1179 - DNA, 16 bp, synthetic construct
  source 1..16: mol_type = other DNA
gtccttgtgtagtcct

SEQ ID NO: 1180 - DNA, 16 bp, synthetic construct
  source 1..16: mol_type = other DNA
gtagatgatggtgatc

SEQ ID NO: 1181 - DNA, 16 bp, synthetic construct
  source 1..16: mol_type = other DNA
aaaacttcaccaacga

SEQ ID NO: 1182 - DNA, 16 bp, synthetic construct
  source 1..16: mol_type = other DNA
ccaatatgctctgtcg

SEQ ID NO: 1183 - DNA, 16 bp, synthetic construct
  source 1..16: mol_type = other DNA
agtttcctccacaccg

SEQ ID NO: 1184 - DNA, 16 bp, synthetic construct
  source 1..16: mol_type = other DNA
accacatacgcatgcg

SEQ ID NO: 1185 - DNA, 16 bp, synthetic construct
  source 1..16: mol_type = other DNA
cttcacctgatttaga

SEQ ID NO: 1186 - DNA, 16 bp, synthetic construct
  source 1..16: mol_type = other DNA
actgtcccagcattat

SEQ ID NO: 1187 - DNA, 16 bp, synthetic construct
  source 1..16: mol_type = other DNA
atccttggtgctgaga

SEQ ID NO: 1188 - DNA, 16 bp, synthetic construct
  source 1..16: mol_type = other DNA
tcctaggatgttgacc

SEQ ID NO: 1189 - DNA, 16 bp, synthetic construct
  source 1..16: mol_type = other DNA
ttctctccatcatcga

SEQ ID NO: 1190 - DNA, 16 bp, synthetic construct
  source 1..16: mol_type = other DNA
tgaggtaaggaatccc

SEQ ID NO: 1191 - DNA, 16 bp, synthetic construct
  source 1..16: mol_type = other DNA
gatgtcagacctctgt

SEQ ID NO: 1192 - DNA, 16 bp, synthetic construct
  source 1..16: mol_type = other DNA
gtgaacccagtattca

SEQ ID NO: 1193 - DNA, 16 bp, synthetic construct
  source 1..16: mol_type = other DNA
tacgacttcatctgtc

SEQ ID NO: 1194 - DNA, 16 bp, synthetic construct
  source 1..16: mol_type = other DNA
tggtaagtattccatc

SEQ ID NO: 1195 - DNA, 16 bp, synthetic construct
  source 1..16: mol_type = other DNA
atttaaaatcgctgag

SEQ ID NO: 1196 - DNA, 16 bp, synthetic construct
  source 1..16: mol_type = other DNA
tttgtggccaaccact

SEQ ID NO: 1197 - DNA, 16 bp, synthetic construct
  source 1..16: mol_type = other DNA
ttatcatgcatacatc

SEQ ID NO: 1198 - DNA, 16 bp, synthetic construct
  source 1..16: mol_type = other DNA
tagtgccaaaccaatg

SEQ ID NO: 1199 - DNA, 16 bp, synthetic construct
  source 1..16: mol_type = other DNA
gtttttaagaggcatg

SEQ ID NO: 1200 - DNA, 16 bp, synthetic construct
  source 1..16: mol_type = other DNA
ctgtgtaaataagttc

SEQ ID NO: 1201 - DNA, 16 bp, synthetic construct
  source 1..16: mol_type = other DNA
ggaatgctacttgaac

SEQ ID NO: 1202 - DNA, 16 bp, synthetic construct
  source 1..16: mol_type = other DNA
ttgatattctgtggca

SEQ ID NO: 1203 - DNA, 16 bp, synthetic construct
  source 1..16: mol_type = other DNA
tgcctgctgaaacttg

SEQ ID NO: 1204 - DNA, 16 bp, synthetic construct
  source 1..16: mol_type = other DNA
gttttgggctaatgaa

SEQ ID NO: 1205 - DNA, 16 bp, synthetic construct
  source 1..16: mol_type = other DNA
gttatacagaagacag

SEQ ID NO: 1206 - DNA, 16 bp, synthetic construct
  source 1..16: mol_type = other DNA
gaaatatagagggtcc

SEQ ID NO: 1207 - DNA, 16 bp, synthetic construct
  source 1..16: mol_type = other DNA
gggctagaacttaaaa

SEQ ID NO: 1208 - DNA, 16 bp, synthetic construct
  source 1..16: mol_type = other DNA
gctttaatttttgagc

SEQ ID NO: 1209 - DNA, 16 bp, synthetic construct
  source 1..16: mol_type = other DNA
ttgggtccattgtttc

SEQ ID NO: 1210 - DNA, 16 bp, synthetic construct
  source 1..16: mol_type = other DNA
agtcttgatgtagtgg

SEQ ID NO: 1211 - DNA, 16 bp, synthetic construct
  source 1..16: mol_type = other DNA
tataactacaagaggt

SEQ ID NO: 1212 - DNA, 16 bp, synthetic construct
  source 1..16: mol_type = other DNA
ctaactaacctgacac

SEQ ID NO: 1213 - DNA, 16 bp, synthetic construct
  source 1..16: mol_type = other DNA
taattttcagatcccg

SEQ ID NO: 1214 - DNA, 16 bp, synthetic construct
  source 1..16: mol_type = other DNA
atatacatcaactcct

SEQ ID NO: 1215 - DNA, 16 bp, synthetic construct
  source 1..16: mol_type = other DNA
gaatttttgaggttgg

SEQ ID NO: 1216 - DNA, 16 bp, synthetic construct
  source 1..16: mol_type = other DNA
ttagattgcataagag

SEQ ID NO: 1217 - DNA, 16 bp, synthetic construct
  source 1..16: mol_type = other DNA
tttagttggtagcttg

SEQ ID NO: 1218 - DNA, 16 bp, synthetic construct
  source 1..16: mol_type = other DNA
aaccttgaatgagtgg

SEQ ID NO: 1219 - DNA, 16 bp, synthetic construct
  source 1..16: mol_type = other DNA
cataggacatggagac

SEQ ID NO: 1220 - DNA, 16 bp, synthetic construct
  source 1..16: mol_type = other DNA
attctaaactagtggt

SEQ ID NO: 1221 - DNA, 16 bp, synthetic construct
  source 1..16: mol_type = other DNA
ctccttatttgttaga

SEQ ID NO: 1222 - DNA, 16 bp, synthetic construct
  source 1..16: mol_type = other DNA
tgacataactacttca

SEQ ID NO: 1223 - DNA, 16 bp, synthetic construct
  source 1..16: mol_type = other DNA
aaagtttgttagagtg

SEQ ID NO: 1224 - DNA, 16 bp, synthetic construct
  source 1..16: mol_type = other DNA
tcataaaggtgggata

SEQ ID NO: 1225 - DNA, 16 bp, synthetic construct
  source 1..16: mol_type = other DNA
gttataagtttcatgt

SEQ ID NO: 1226 - DNA, 16 bp, synthetic construct
  source 1..16: mol_type = other DNA
gcattgaaaagatgta

SEQ ID NO: 1227 - DNA, 16 bp, synthetic construct
  source 1..16: mol_type = other DNA
tctatacaaaggcagt

SEQ ID NO: 1228 - DNA, 16 bp, synthetic construct
  source 1..16: mol_type = other DNA
taatgtatgaggtctc

SEQ ID NO: 1229 - DNA, 16 bp, synthetic construct
  source 1..16: mol_type = other DNA
atgattgaattcacta

SEQ ID NO: 1230 - DNA, 16 bp, synthetic construct
  source 1..16: mol_type = other DNA
taaacaatattaaggg

SEQ ID NO: 1231 - DNA, 16 bp, synthetic construct
  source 1..16: mol_type = other DNA
ccaatatgggatgagg

SEQ ID NO: 1232 - DNA, 16 bp, synthetic construct
  source 1..16: mol_type = other DNA
ttacaacctggtttca

SEQ ID NO: 1233 - DNA, 16 bp, synthetic construct
  source 1..16: mol_type = other DNA
tgacaatggttgccac

SEQ ID NO: 1234 - DNA, 16 bp, synthetic construct
  source 1..16: mol_type = other DNA
tgattaagcagaattg

SEQ ID NO: 1235 - DNA, 16 bp, synthetic construct
  source 1..16: mol_type = other DNA
tcaatttatcatacca

SEQ ID NO: 1236 - DNA, 16 bp, synthetic construct
  source 1..16: mol_type = other DNA
gacaagagttcttgca

SEQ ID NO: 1237 - DNA, 16 bp, synthetic construct
  source 1..16: mol_type = other DNA
tttcgaatcattaagc

SEQ ID NO: 1238 - DNA, 16 bp, synthetic construct
  source 1..16: mol_type = other DNA
acctatggtctaacac

SEQ ID NO: 1239 - DNA, 16 bp, synthetic construct
  source 1..16: mol_type = other DNA
ttgcaatagtactata

SEQ ID NO: 1240 - DNA, 16 bp, synthetic construct
  source 1..16: mol_type = other DNA
tatttagcattgcctg

SEQ ID NO: 1241 - DNA, 16 bp, synthetic construct
  source 1..16: mol_type = other DNA
ctaaattactccgttc

SEQ ID NO: 1242 - DNA, 16 bp, synthetic construct
  source 1..16: mol_type = other DNA
tagaattgtctgttag

SEQ ID NO: 1243 - DNA, 16 bp, synthetic construct
  source 1..16: mol_type = other DNA
cgtatttgagattcac

SEQ ID NO: 1244 - DNA, 16 bp, synthetic construct
  source 1..16: mol_type = other DNA
agctaagtatactttc

SEQ ID NO: 1245 - DNA, 16 bp, synthetic construct
  source 1..16: mol_type = other DNA
agatggtaaggagtag

SEQ ID NO: 1246 - DNA, 16 bp, synthetic construct
  source 1..16: mol_type = other DNA
atattccaggatttgc

SEQ ID NO: 1247 - DNA, 16 bp, synthetic construct
  source 1..16: mol_type = other DNA
gcaaagtttgggcaga

SEQ ID NO: 1248 - DNA, 16 bp, synthetic construct
  source 1..16: mol_type = other DNA
aaaaaagcttatcgag

SEQ ID NO: 1249 - DNA, 16 bp, synthetic construct
  source 1..16: mol_type = other DNA
agttagtatagttatc

SEQ ID NO: 1250 - DNA, 16 bp, synthetic construct
  source 1..16: mol_type = other DNA
aaagactttgagactc

SEQ ID NO: 1251 - DNA, 16 bp, synthetic construct
  source 1..16: mol_type = other DNA
gaaagatggaatgagc

SEQ ID NO: 1252 - DNA, 16 bp, synthetic construct
  source 1..16: mol_type = other DNA
aggtaaactaaagtac

SEQ ID NO: 1253 - DNA, 16 bp, synthetic construct
  source 1..16: mol_type = other DNA
cataccactcttctca

SEQ ID NO: 1254 - DNA, 16 bp, synthetic construct
  source 1..16: mol_type = other DNA
atgcattaaaactctc

SEQ ID NO: 1255 - DNA, 16 bp, synthetic construct
  source 1..16: mol_type = other DNA
acaagtaaggtaaagt

SEQ ID NO: 1256 - DNA, 16 bp, synthetic construct
  source 1..16: mol_type = other DNA
agagttatctggtttg

SEQ ID NO: 1257 - DNA, 16 bp, synthetic construct
  source 1..16: mol_type = other DNA
agtccttgtgtagtcc

SEQ ID NO: 1258 - DNA, 16 bp, synthetic construct
  source 1..16: mol_type = other DNA
gagtagatgatggtga

SEQ ID NO: 1259 - DNA, 16 bp, synthetic construct
  source 1..16: mol_type = other DNA
aaaaacttcaccaacg

SEQ ID NO: 1260 - DNA, 16 bp, synthetic construct
  source 1..16: mol_type = other DNA
accaatatgctctgtc

SEQ ID NO: 1261 - DNA, 16 bp, synthetic construct
  source 1..16: mol_type = other DNA
cactcagctgcagttt

SEQ ID NO: 1262 - DNA, 16 bp, synthetic construct
  source 1..16: mol_type = other DNA
taccacatacgcatgc

SEQ ID NO: 1263 - DNA, 16 bp, synthetic construct
  source 1..16: mol_type = other DNA
tcttcacctgatttag

SEQ ID NO: 1264 - DNA, 16 bp, synthetic construct
  source 1..16: mol_type = other DNA
tactgtcccagcatta

SEQ ID NO: 1265 - DNA, 16 bp, synthetic construct
  source 1..16: mol_type = other DNA
catccttggtgctgag

SEQ ID NO: 1266 - DNA, 16 bp, synthetic construct
  source 1..16: mol_type = other DNA
gtcctaggatgttgac

SEQ ID NO: 1267 - DNA, 16 bp, synthetic construct
  source 1..16: mol_type = other DNA
tttctctccatcatcg

SEQ ID NO: 1268 - DNA, 16 bp, synthetic construct
  source 1..16: mol_type = other DNA
atgaggtaaggaatcc

SEQ ID NO: 1269 - DNA, 16 bp, synthetic construct
  source 1..16: mol_type = other DNA
ctgatgtcagacctct

SEQ ID NO: 1270 - DNA, 16 bp, synthetic construct
  source 1..16: mol_type = other DNA
ggtgaacccagtattc

SEQ ID NO: 1271 - DNA, 16 bp, synthetic construct
  source 1..16: mol_type = other DNA
ttacgacttcatctgt

SEQ ID NO: 1272 - DNA, 16 bp, synthetic construct
  source 1..16: mol_type = other DNA
tattggtaagtattcc

SEQ ID NO: 1273 - DNA, 16 bp, synthetic construct
  source 1..16: mol_type = other DNA
gatttaaaatcgctga

SEQ ID NO: 1274 - DNA, 16 bp, synthetic construct
  source 1..16: mol_type = other DNA
ttttgtggccaaccac

SEQ ID NO: 1275 - DNA, 16 bp, synthetic construct
  source 1..16: mol_type = other DNA
tcattatcatgcatac

SEQ ID NO: 1276 - DNA, 16 bp, synthetic construct
  source 1..16: mol_type = other DNA
ctagtgccaaaccaat

SEQ ID NO: 1277 - DNA, 16 bp, synthetic construct
  source 1..16: mol_type = other DNA
gaagtttttaagaggc

SEQ ID NO: 1278 - DNA, 16 bp, synthetic construct
  source 1..16: mol_type = other DNA
cctgtgtaaataagtt

SEQ ID NO: 1279 - DNA, 16 bp, synthetic construct
  source 1..16: mol_type = other DNA
ttggaatgctacttga

SEQ ID NO: 1280 - DNA, 16 bp, synthetic construct
  source 1..16: mol_type = other DNA
gttgatattctgtggc

SEQ ID NO: 1281 - DNA, 16 bp, synthetic construct
  source 1..16: mol_type = other DNA
gctgcctgctgaaact

SEQ ID NO: 1282 - DNA, 16 bp, synthetic construct
  source 1..16: mol_type = other DNA
cgttttgggctaatga

SEQ ID NO: 1283 - DNA, 16 bp, synthetic construct
  source 1..16: mol_type = other DNA
gagttatacagaagac

SEQ ID NO: 1284 - DNA, 16 bp, synthetic construct
  source 1..16: mol_type = other DNA
ggaaatatagagggtc

SEQ ID NO: 1285 - DNA, 16 bp, synthetic construct
  source 1..16: mol_type = other DNA
aaaaggttatcatggg

SEQ ID NO: 1286 - DNA, 16 bp, synthetic construct
  source 1..16: mol_type = other DNA
ctgtgttagctttaat

SEQ ID NO: 1287 - DNA, 16 bp, synthetic construct
  source 1..16: mol_type = other DNA
cttgggtccattgttt

SEQ ID NO: 1288 - DNA, 16 bp, synthetic construct
  source 1..16: mol_type = other DNA
tagtcttgatgtagtg

SEQ ID NO: 1289 - DNA, 16 bp, synthetic construct
  source 1..16: mol_type = other DNA
ttataactacaagagg

SEQ ID NO: 1290 - DNA, 16 bp, synthetic construct
  source 1..16: mol_type = other DNA
atctaactaacctgac

SEQ ID NO: 1291 - DNA, 16 bp, synthetic construct
  source 1..16: mol_type = other DNA
gtaattttcagatccc

SEQ ID NO: 1292 - DNA, 16 bp, synthetic construct
  source 1..16: mol_type = other DNA
tatatacatcaactcc

SEQ ID NO: 1293 - DNA, 16 bp, synthetic construct
  source 1..16: mol_type = other DNA
gcttaaatgtttaacc

SEQ ID NO: 1294 - DNA, 16 bp, synthetic construct
  source 1..16: mol_type = other DNA
gtttagattgcataag

SEQ ID NO: 1295 - DNA, 16 bp, synthetic construct
  source 1..16: mol_type = other DNA
atttagttggtagctt

SEQ ID NO: 1296 - DNA, 16 bp, synthetic construct
  source 1..16: mol_type = other DNA
aaaccttgaatgagtg

SEQ ID NO: 1297 - DNA, 16 bp, synthetic construct
  source 1..16: mol_type = other DNA
ccataggacatggaga

SEQ ID NO: 1298 - DNA, 16 bp, synthetic construct
  source 1..16: mol_type = other DNA
aattctaaactagtgg

SEQ ID NO: 1299 - DNA, 16 bp, synthetic construct
  source 1..16: mol_type = other DNA
taaaaattggcctcct

SEQ ID NO: 1300 - DNA, 16 bp, synthetic construct
  source 1..16: mol_type = other DNA
atatatccttccttgg

SEQ ID NO: 1301 - DNA, 16 bp, synthetic construct
  source 1..16: mol_type = other DNA
gtaaagtttgttagag

SEQ ID NO: 1302 - DNA, 16 bp, synthetic construct
  source 1..16: mol_type = other DNA
gtcataaaggtgggat

SEQ ID NO: 1303 - DNA, 16 bp, synthetic construct
  source 1..16: mol_type = other DNA
cgttataagtttcatg

SEQ ID NO: 1304 - DNA, 16 bp, synthetic construct
  source 1..16: mol_type = other DNA
aatcatggtgtggagg

SEQ ID NO: 1305 - DNA, 16 bp, synthetic construct
  source 1..16: mol_type = other DNA
ggaagattaatcataa

SEQ ID NO: 1306 - DNA, 16 bp, synthetic construct
  source 1..16: mol_type = other DNA
ctaatgtatgaggtct

SEQ ID NO: 1307 - DNA, 16 bp, synthetic construct
  source 1..16: mol_type = other DNA
taatgaatcatgattg

SEQ ID NO: 1308 - DNA, 16 bp, synthetic construct
  source 1..16: mol_type = other DNA
gaatcaaatagatcct

SEQ ID NO: 1309 - DNA, 16 bp, synthetic construct
  source 1..16: mol_type = other DNA
accaatatgggatgag

SEQ ID NO: 1310 - DNA, 16 bp, synthetic construct
  source 1..16: mol_type = other DNA
ataattacaacctggt

SEQ ID NO: 1311 - DNA, 16 bp, synthetic construct
  source 1..16: mol_type = other DNA
ctcttgacaatggttg

SEQ ID NO: 1312 - DNA, 16 bp, synthetic construct
  source 1..16: mol_type = other DNA
catgattaagcagaat

SEQ ID NO: 1313 - DNA, 16 bp, synthetic construct
  source 1..16: mol_type = other DNA
atcaatttatcatacc

SEQ ID NO: 1314 - DNA, 16 bp, synthetic construct
  source 1..16: mol_type = other DNA
agacaagagttcttgc

SEQ ID NO: 1315 - DNA, 16 bp, synthetic construct
  source 1..16: mol_type = other DNA
aaattggtttcgaatc

SEQ ID NO: 1316 - DNA, 16 bp, synthetic construct
  source 1..16: mol_type = other DNA
ctttagtcaacagtac

SEQ ID NO: 1317 - DNA, 16 bp, synthetic construct
  source 1..16: mol_type = other DNA
aacaatcaggagttgc

SEQ ID NO: 1318 - DNA, 16 bp, synthetic construct
  source 1..16: mol_type = other DNA
ctctataaaatcaatc

SEQ ID NO: 1319 - DNA, 16 bp, synthetic construct
  source 1..16: mol_type = other DNA
tctaaattactccgtt

SEQ ID NO: 1320 - DNA, 16 bp, synthetic construct
  source 1..16: mol_type = other DNA
gtagaattgtctgtta

SEQ ID NO: 1321 - DNA, 16 bp, synthetic construct
  source 1..16: mol_type = other DNA
tccggtaagaatttcg

SEQ ID NO: 1322 - DNA, 16 bp, synthetic construct
  source 1..16: mol_type = other DNA
tagctaagtatacttt

SEQ ID NO: 1323 - DNA, 16 bp, synthetic construct
  source 1..16: mol_type = other DNA
attagatggtaaggag

SEQ ID NO: 1324 - DNA, 16 bp, synthetic construct
  source 1..16: mol_type = other DNA
gtaaatgatggcagga

SEQ ID NO: 1325 - DNA, 16 bp, synthetic construct
  source 1..16: mol_type = other DNA
agcaaagtttgggcag

SEQ ID NO: 1326 - DNA, 16 bp, synthetic construct
  source 1..16: mol_type = other DNA
aaattagaggcccagg

SEQ ID NO: 1327 - DNA, 16 bp, synthetic construct
  source 1..16: mol_type = other DNA
gaagttagtatagtta

SEQ ID NO: 1328 - DNA, 16 bp, synthetic construct
  source 1..16: mol_type = other DNA
ctagttacaaaccacc

SEQ ID NO: 1329 - DNA, 16 bp, synthetic construct
  source 1..16: mol_type = other DNA
agatttacttccttgt

SEQ ID NO: 1330 - DNA, 16 bp, synthetic construct
  source 1..16: mol_type = other DNA
taaggtaaactaaagt

SEQ ID NO: 1331 - DNA, 16 bp, synthetic construct
  source 1..16: mol_type = other DNA
atacataccactcttc

SEQ ID NO: 1332 - DNA, 16 bp, synthetic construct
  source 1..16: mol_type = other DNA
agtaactttattaacg

SEQ ID NO: 1333 - DNA, 16 bp, synthetic construct
  source 1..16: mol_type = other DNA
aatcacaagtaaggta

SEQ ID NO: 1334 - DNA, 16 bp, synthetic construct
  source 1..16: mol_type = other DNA
gaatacgctgagagtt

SEQ ID NO: 1335 - DNA, 16 bp, synthetic construct
  source 1..16: mol_type = other DNA
cagtccttgtgtagtc

SEQ ID NO: 1336 - DNA, 16 bp, synthetic construct
  source 1..16: mol_type = other DNA
ggagtagatgatggtg

SEQ ID NO: 1337 - DNA, 16 bp, synthetic construct
  source 1..16: mol_type = other DNA
gccacagattttctcc

SEQ ID NO: 1338 - DNA, 16 bp, synthetic construct
  source 1..16: mol_type = other DNA
aaccaatatgctctgt

SEQ ID NO: 1339 - DNA, 16 bp, synthetic construct
  source 1..16: mol_type = other DNA
gcactcagctgcagtt

SEQ ID NO: 1340 - DNA, 16 bp, synthetic construct
  source 1..16: mol_type = other DNA
ctaccacatacgcatg

SEQ ID NO: 1341 - DNA, 16 bp, synthetic construct
  source 1..16: mol_type = other DNA
tacatcacccacttct

SEQ ID NO: 1342 - DNA, 16 bp, synthetic construct
  source 1..16: mol_type = other DNA
atactgtcccagcatt

SEQ ID NO: 1343 - DNA, 16 bp, synthetic construct
  source 1..16: mol_type = other DNA
tcatccttggtgctga

SEQ ID NO: 1344 - DNA, 16 bp, synthetic construct
  source 1..16: mol_type = other DNA
tgtcctaggatgttga

SEQ ID NO: 1345 - DNA, 16 bp, synthetic construct
  source 1..16: mol_type = other DNA
gtggccatgatttctc

SEQ ID NO: 1346 - DNA, 16 bp, synthetic construct
  source 1..16: mol_type = other DNA
gatgaggtaaggaatc

SEQ ID NO: 1347 - DNA, 16 bp, synthetic construct
  source 1..16: mol_type = other DNA
tctgatgtcagacctc

SEQ ID NO: 1348 - DNA, 16 bp, synthetic construct
  source 1..16: mol_type = other DNA
tggtgaacccagtatt

SEQ ID NO: 1349 - DNA, 16 bp, synthetic construct
  source 1..16: mol_type = other DNA
cttacgacttcatctg

SEQ ID NO: 1350 - DNA, 16 bp, synthetic construct
  source 1..16: mol_type = other DNA
cttattggtaagtatt

SEQ ID NO: 1351 - DNA, 16 bp, synthetic construct
  source 1..16: mol_type = other DNA
cgatttaaaatcgctg

SEQ ID NO: 1352 - DNA, 16 bp, synthetic construct
  source 1..16: mol_type = other DNA
attttgtggccaacca

SEQ ID NO: 1353 - DNA, 16 bp, synthetic construct
  source 1..16: mol_type = other DNA
catatcattatcatgc

SEQ ID NO: 1354 - DNA, 16 bp, synthetic construct
  source 1..16: mol_type = other DNA
gctagtgccaaaccaa

SEQ ID NO: 1355 - DNA, 16 bp, synthetic construct
  source 1..16: mol_type = other DNA
gtaagcacagaagttt

SEQ ID NO: 1356 - DNA, 16 bp, synthetic construct
  source 1..16: mol_type = other DNA
ccctgtgtaaataagt

SEQ ID NO: 1357 - DNA, 16 bp, synthetic construct
  source 1..16: mol_type = other DNA
attggaatgctacttg

SEQ ID NO: 1358 - DNA, 16 bp, synthetic construct
  source 1..16: mol_type = other DNA
tgttgatattctgtgg

SEQ ID NO: 1359 - DNA, 16 bp, synthetic construct
  source 1..16: mol_type = other DNA
taaagctgcctgctga

SEQ ID NO: 1360 - DNA, 16 bp, synthetic construct
  source 1..16: mol_type = other DNA
ccgttttgggctaatg

SEQ ID NO: 1361 - DNA, 16 bp, synthetic construct
  source 1..16: mol_type = other DNA
cttcagagttatacag

SEQ ID NO: 1362 - DNA, 16 bp, synthetic construct
  source 1..16: mol_type = other DNA
aggaaatatagagggt

SEQ ID NO: 1363 - DNA, 16 bp, synthetic construct
  source 1..16: mol_type = other DNA
gaaaaaggttatcatg

SEQ ID NO: 1364 - DNA, 16 bp, synthetic construct
  source 1..16: mol_type = other DNA
cctgtgttagctttaa

SEQ ID NO: 1365 - DNA, 16 bp, synthetic construct
  source 1..16: mol_type = other DNA
tcttgggtccattgtt

SEQ ID NO: 1366 - DNA, 16 bp, synthetic construct
  source 1..16: mol_type = other DNA
ttagtcttgatgtagt

SEQ ID NO: 1367 - DNA, 16 bp, synthetic construct
  source 1..16: mol_type = other DNA
gtttagaagtcaaacg

SEQ ID NO: 1368 - DNA, 16 bp, synthetic construct
  source 1..16: mol_type = other DNA
catctaactaacctga

SEQ ID NO: 1369 - DNA, 16 bp, synthetic construct
  source 1..16: mol_type = other DNA
taaaggtttctgttgc

SEQ ID NO: 1370 - DNA, 16 bp, synthetic construct
  source 1..16: mol_type = other DNA
attcgaatttcttcaa

SEQ ID NO: 1371 - DNA, 16 bp, synthetic construct
  source 1..16: mol_type = other DNA
gaatcattcagtagct

SEQ ID NO: 1372 - DNA, 16 bp, synthetic construct
  source 1..16: mol_type = other DNA
cagtttagattgcata

SEQ ID NO: 1373 - DNA, 16 bp, synthetic construct
  source 1..16: mol_type = other DNA
gatttagttggtagct

SEQ ID NO: 1374 - DNA, 16 bp, synthetic construct
  source 1..16: mol_type = other DNA
caaaccttgaatgagt

SEQ ID NO: 1375 - DNA, 16 bp, synthetic construct
  source 1..16: mol_type = other DNA
accataggacatggag

SEQ ID NO: 1376 - DNA, 16 bp, synthetic construct
  source 1..16: mol_type = other DNA
taattctaaactagtg

SEQ ID NO: 1377 - DNA, 16 bp, synthetic construct
  source 1..16: mol_type = other DNA
ataaaaattggcctcc

SEQ ID NO: 1378 - DNA, 16 bp, synthetic construct
  source 1..16: mol_type = other DNA
tggattacatacaaga

SEQ ID NO: 1379 - DNA, 16 bp, synthetic construct
  source 1..16: mol_type = other DNA
tgtaaagtttgttaga

SEQ ID NO: 1380 - DNA, 16 bp, synthetic construct
  source 1..16: mol_type = other DNA
tgtcataaaggtggga

SEQ ID NO: 1381 - DNA, 16 bp, synthetic construct
  source 1..16: mol_type = other DNA
ccgttataagtttcat

SEQ ID NO: 1382 - DNA, 16 bp, synthetic construct
  source 1..16: mol_type = other DNA
aaatcatggtgtggag

SEQ ID NO: 1383 - DNA, 16 bp, synthetic construct
  source 1..16: mol_type = other DNA
ctggaagattaatcat

SEQ ID NO: 1384 - DNA, 16 bp, synthetic construct
  source 1..16: mol_type = other DNA
agctaatgtatgaggt

SEQ ID NO: 1385 - DNA, 16 bp, synthetic construct
  source 1..16: mol_type = other DNA
ctaatgaatcatgatt

SEQ ID NO: 1386 - DNA, 16 bp, synthetic construct
  source 1..16: mol_type = other DNA
ctaatctcagtactcc

SEQ ID NO: 1387 - DNA, 16 bp, synthetic construct
  source 1..16: mol_type = other DNA
taccaatatgggatga

SEQ ID NO: 1388 - DNA, 16 bp, synthetic construct
  source 1..16: mol_type = other DNA
tataattacaacctgg

SEQ ID NO: 1389 - DNA, 16 bp, synthetic construct
  source 1..16: mol_type = other DNA
tctcttgacaatggtt

SEQ ID NO: 1390 - DNA, 16 bp, synthetic construct
  source 1..16: mol_type = other DNA
cttacatgattaagca

SEQ ID NO: 1391 - DNA, 16 bp, synthetic construct
  source 1..16: mol_type = other DNA
gcctaaacatttctca

SEQ ID NO: 1392 - DNA, 16 bp, synthetic construct
  source 1..16: mol_type = other DNA
gagacaagagttcttg

SEQ ID NO: 1393 - DNA, 16 bp, synthetic construct
  source 1..16: mol_type = other DNA
aaaaattggtttcgaa

SEQ ID NO: 1394 - DNA, 16 bp, synthetic construct
  source 1..16: mol_type = other DNA
ctctctaaagggctgc

SEQ ID NO: 1395 - DNA, 16 bp, synthetic construct
  source 1..16: mol_type = other DNA
ttttattgggcccaat

SEQ ID NO: 1396 - DNA, 16 bp, synthetic construct
  source 1..16: mol_type = other DNA
atctagcaacctctat

SEQ ID NO: 1397 - DNA, 16 bp, synthetic construct
  source 1..16: mol_type = other DNA
ttctaaattactccgt

SEQ ID NO: 1398 - DNA, 16 bp, synthetic construct
  source 1..16: mol_type = other DNA
gtgtagaattgtctgt

SEQ ID NO: 1399 - DNA, 16 bp, synthetic construct
  source 1..16: mol_type = other DNA
ttccggtaagaatttc

SEQ ID NO: 1400 - DNA, 16 bp, synthetic construct
  source 1..16: mol_type = other DNA
tatagctaagtatact

SEQ ID NO: 1401 - DNA, 16 bp, synthetic construct
  source 1..16: mol_type = other DNA
cattagatggtaagga

SEQ ID NO: 1402 - DNA, 16 bp, synthetic construct
  source 1..16: mol_type = other DNA
agtaaatgatggcagg

SEQ ID NO: 1403 - DNA, 16 bp, synthetic construct
  source 1..16: mol_type = other DNA
tagaatagtcttcagc

SEQ ID NO: 1404 - DNA, 16 bp, synthetic construct
  source 1..16: mol_type = other DNA
aatagccatgtagcta

SEQ ID NO: 1405 - DNA, 16 bp, synthetic construct
  source 1..16: mol_type = other DNA
tgaagttagtatagtt

SEQ ID NO: 1406 - DNA, 16 bp, synthetic construct
  source 1..16: mol_type = other DNA
cctagttacaaaccac

SEQ ID NO: 1407 - DNA, 16 bp, synthetic construct
  source 1..16: mol_type = other DNA
tgcaagatttacttcc

SEQ ID NO: 1408 - DNA, 16 bp, synthetic construct
  source 1..16: mol_type = other DNA
ctctataataaggtaa

SEQ ID NO: 1409 - DNA, 16 bp, synthetic construct
  source 1..16: mol_type = other DNA
gatacataccactctt

SEQ ID NO: 1410 - DNA, 16 bp, synthetic construct
  source 1..16: mol_type = other DNA
caagacattctagcct

SEQ ID NO: 1411 - DNA, 16 bp, synthetic construct
  source 1..16: mol_type = other DNA
gtaatcacaagtaagg

SEQ ID NO: 1412 - DNA, 16 bp, synthetic construct
  source 1..16: mol_type = other DNA
agaatacgctgagagt

SEQ ID NO: 1413 - DNA, 16 bp, synthetic construct
  source 1..16: mol_type = other DNA
tcagtccttgtgtagt

SEQ ID NO: 1414 - DNA, 16 bp, synthetic construct
  source 1..16: mol_type = other DNA
taggagtagatgatgg

SEQ ID NO: 1415 - DNA, 16 bp, synthetic construct
  source 1..16: mol_type = other DNA
acaatctccccagcca

SEQ ID NO: 1416 - DNA, 16 bp, synthetic construct
  source 1..16: mol_type = other DNA
gaaccaatatgctctg

SEQ ID NO: 1417 - DNA, 16 bp, synthetic construct
  source 1..16: mol_type = other DNA
ggcactcagctgcagt

SEQ ID NO: 1418 - DNA, 16 bp, synthetic construct
  source 1..16: mol_type = other DNA
tctaccacatacgcat

SEQ ID NO: 1419 - DNA, 16 bp, synthetic construct
  source 1..16: mol_type = other DNA
ttacatcacccacttc

SEQ ID NO: 1420 - DNA, 16 bp, synthetic construct
  source 1..16: mol_type = other DNA
tatactgtcccagcat

SEQ ID NO: 1421 - DNA, 16 bp, synthetic construct
  source 1..16: mol_type = other DNA
cttcatccttggtgct

SEQ ID NO: 1422 - DNA, 16 bp, synthetic construct
  source 1..16: mol_type = other DNA
atgtcctaggatgttg

SEQ ID NO: 1423 - DNA, 16 bp, synthetic construct
  source 1..16: mol_type = other DNA
gatgtggccatgattt

SEQ ID NO: 1424 - DNA, 16 bp, synthetic construct
  source 1..16: mol_type = other DNA
aatatgggatgaggta

SEQ ID NO: 1425 - DNA, 16 bp, synthetic construct
  source 1..16: mol_type = other DNA
ttctgatgtcagacct

SEQ ID NO: 1426 - DNA, 16 bp, synthetic construct
  source 1..16: mol_type = other DNA
ttggtgaacccagtat

SEQ ID NO: 1427 - DNA, 16 bp, synthetic construct
  source 1..16: mol_type = other DNA
tcttacgacttcatct

SEQ ID NO: 1428 - DNA, 16 bp, synthetic construct
  source 1..16: mol_type = other DNA
tcttattggtaagtat

SEQ ID NO: 1429 - DNA, 16 bp, synthetic construct
  source 1..16: mol_type = other DNA
acgatttaaaatcgct

SEQ ID NO: 1430 - DNA, 16 bp, synthetic construct
  source 1..16: mol_type = other DNA
gattttgtggccaacc

SEQ ID NO: 1431 - DNA, 16 bp, synthetic construct
  source 1..16: mol_type = other DNA
cgaaactattcatatc

SEQ ID NO: 1432 - DNA, 16 bp, synthetic construct
  source 1..16: mol_type = other DNA
tgctagtgccaaacca

SEQ ID NO: 1433 - DNA, 16 bp, synthetic construct
  source 1..16: mol_type = other DNA
gtttatgtaagcacag

SEQ ID NO: 1434 - DNA, 16 bp, synthetic construct
  source 1..16: mol_type = other DNA
tccctgtgtaaataag

SEQ ID NO: 1435 - DNA, 16 bp, synthetic construct
  source 1..16: mol_type = other DNA
gattggaatgctactt

SEQ ID NO: 1436 - DNA, 16 bp, synthetic construct
  source 1..16: mol_type = other DNA
gttcttgttgatattc

SEQ ID NO: 1437 - DNA, 16 bp, synthetic construct
  source 1..16: mol_type = other DNA
gataaagctgcctgct

SEQ ID NO: 1438 - DNA, 16 bp, synthetic construct
  source 1..16: mol_type = other DNA
accgttttgggctaat

SEQ ID NO: 1439 - DNA, 16 bp, synthetic construct
  source 1..16: mol_type = other DNA
gacttcagagttatac

SEQ ID NO: 1440 - DNA, 16 bp, synthetic construct
  source 1..16: mol_type = other DNA
gactataaaaagggag

SEQ ID NO: 1441 - DNA, 16 bp, synthetic construct
  source 1..16: mol_type = other DNA
gaccaaggatatatga

SEQ ID NO: 1442 - DNA, 16 bp, synthetic construct
  source 1..16: mol_type = other DNA
tcctgtgttagcttta

SEQ ID NO: 1443 - DNA, 16 bp, synthetic construct
  source 1..16: mol_type = other DNA
ctcttgggtccattgt

SEQ ID NO: 1444 - DNA, 16 bp, synthetic construct
  source 1..16: mol_type = other DNA
attagtcttgatgtag

SEQ ID NO: 1445 - DNA, 16 bp, synthetic construct
  source 1..16: mol_type = other DNA
agtttagaagtcaaac

SEQ ID NO: 1446 - DNA, 16 bp, synthetic construct
  source 1..16: mol_type = other DNA
tcttaattacattccc

SEQ ID NO: 1447 - DNA, 16 bp, synthetic construct
  source 1..16: mol_type = other DNA
ctaaaggtttctgttg

SEQ ID NO: 1448 - DNA, 16 bp, synthetic construct
  source 1..16: mol_type = other DNA
cattcgaatttcttca

SEQ ID NO: 1449 - DNA, 16 bp, synthetic construct
  source 1..16: mol_type = other DNA
agtgaatcattcagta

SEQ ID NO: 1450 - DNA, 16 bp, synthetic construct
  source 1..16: mol_type = other DNA
acagtttagattgcat

SEQ ID NO: 1451 - DNA, 16 bp, synthetic construct
  source 1..16: mol_type = other DNA
tgatttagttggtagc

SEQ ID NO: 1452 - DNA, 16 bp, synthetic construct
  source 1..16: mol_type = other DNA
ggcaaaccttgaatga

SEQ ID NO: 1453 - DNA, 16 bp, synthetic construct
  source 1..16: mol_type = other DNA
aaccataggacatgga

SEQ ID NO: 1454 - DNA, 16 bp, synthetic construct
  source 1..16: mol_type = other DNA
gtaattctaaactagt

SEQ ID NO: 1455 - DNA, 16 bp, synthetic construct
  source 1..16: mol_type = other DNA
ctcgggaagtttagac

SEQ ID NO: 1456 - DNA, 16 bp, synthetic construct
  source 1..16: mol_type = other DNA
gtggattacatacaag

SEQ ID NO: 1457 - DNA, 16 bp, synthetic construct
  source 1..16: mol_type = other DNA
atgtaaagtttgttag

SEQ ID NO: 1458 - DNA, 16 bp, synthetic construct
  source 1..16: mol_type = other DNA
caagggaacactgtca

SEQ ID NO: 1459 - DNA, 16 bp, synthetic construct
  source 1..16: mol_type = other DNA
tccgttataagtttca

SEQ ID NO: 1460 - DNA, 16 bp, synthetic construct
  source 1..16: mol_type = other DNA
acaaaatcatggtgtg

SEQ ID NO: 1461 - DNA, 16 bp, synthetic construct
  source 1..16: mol_type = other DNA
atattgaggcactgga

SEQ ID NO: 1462 - DNA, 16 bp, synthetic construct
  source 1..16: mol_type = other DNA
tagctaatgtatgagg

SEQ ID NO: 1463 - DNA, 16 bp, synthetic construct
  source 1..16: mol_type = other DNA
actaatgaatcatgat

SEQ ID NO: 1464 - DNA, 16 bp, synthetic construct
  source 1..16: mol_type = other DNA
actaatctcagtactc

SEQ ID NO: 1465 - DNA, 16 bp, synthetic construct
  source 1..16: mol_type = other DNA
cttaccaatatgggat

SEQ ID NO: 1466 - DNA, 16 bp, synthetic construct
  source 1..16: mol_type = other DNA
tggaaacatgcttggc

SEQ ID NO: 1467 - DNA, 16 bp, synthetic construct
  source 1..16: mol_type = other DNA
ttctcttgacaatggt

SEQ ID NO: 1468 - DNA, 16 bp, synthetic construct
  source 1..16: mol_type = other DNA
gtataaatggcaattc

SEQ ID NO: 1469 - DNA, 16 bp, synthetic construct
  source 1..16: mol_type = other DNA
tattagttggcctgcc

SEQ ID NO: 1470 - DNA, 16 bp, synthetic construct
  source 1..16: mol_type = other DNA
tcttatccacaccttc

SEQ ID NO: 1471 - DNA, 16 bp, synthetic construct
  source 1..16: mol_type = other DNA
aaaaaattggtttcga

SEQ ID NO: 1472 - DNA, 16 bp, synthetic construct
  source 1..16: mol_type = other DNA
ctatcagaacagttca

SEQ ID NO: 1473 - DNA, 16 bp, synthetic construct
  source 1..16: mol_type = other DNA
tttttattgggcccaa

SEQ ID NO: 1474 - DNA, 16 bp, synthetic construct
  source 1..16: mol_type = other DNA
aatctagcaacctcta

SEQ ID NO: 1475 - DNA, 16 bp, synthetic construct
  source 1..16: mol_type = other DNA
tttctaaattactccg

SEQ ID NO: 1476 - DNA, 16 bp, synthetic construct
  source 1..16: mol_type = other DNA
tagtgtagaattgtct

SEQ ID NO: 1477 - DNA, 16 bp, synthetic construct
  source 1..16: mol_type = other DNA
agaaatctaagaaccc

SEQ ID NO: 1478 - DNA, 16 bp, synthetic construct
  source 1..16: mol_type = other DNA
attctatagctaagta

SEQ ID NO: 1479 - DNA, 16 bp, synthetic construct
  source 1..16: mol_type = other DNA
gcattagatggtaagg

SEQ ID NO: 1480 - DNA, 16 bp, synthetic construct
  source 1..16: mol_type = other DNA
ccataatctgtgatta

SEQ ID NO: 1481 - DNA, 16 bp, synthetic construct
  source 1..16: mol_type = other DNA
gttagaatagtcttca

SEQ ID NO: 1482 - DNA, 16 bp, synthetic construct
  source 1..16: mol_type = other DNA
gaatagccatgtagct

SEQ ID NO: 1483 - DNA, 16 bp, synthetic construct
  source 1..16: mol_type = other DNA
atgaagttagtatagt

SEQ ID NO: 1484 - DNA, 16 bp, synthetic construct
  source 1..16: mol_type = other DNA
gcctagttacaaacca

SEQ ID NO: 1485 - DNA, 16 bp, synthetic construct
  source 1..16: mol_type = other DNA
gactaatgcaagattt

SEQ ID NO: 1486 - DNA, 16 bp, synthetic construct
  source 1..16: mol_type = other DNA
actctataataaggta

SEQ ID NO: 1487 - DNA, 16 bp, synthetic construct
  source 1..16: mol_type = other DNA
actgatacataccact

SEQ ID NO: 1488 - DNA, 16 bp, synthetic construct
  source 1..16: mol_type = other DNA
atcaagacattctagc

SEQ ID NO: 1489 - DNA, 16 bp, synthetic construct
  source 1..16: mol_type = other DNA
tagtaatcacaagtaa

SEQ ID NO: 1490 - DNA, 16 bp, synthetic construct
  source 1..16: mol_type = other DNA
tagaatacgctgagag

SEQ ID NO: 1491 - DNA, 16 bp, synthetic construct
  source 1..16: mol_type = other DNA
ttcagtccttgtgtag

SEQ ID NO: 1492 - DNA, 16 bp, synthetic construct
  source 1..16: mol_type = other DNA
gtaggagtagatgatg

SEQ ID NO: 1493 - DNA, 16 bp, synthetic construct
  source 1..16: mol_type = other DNA
aacaatctccccagcc

SEQ ID NO: 1494 - DNA, 16 bp, synthetic construct
  source 1..16: mol_type = other DNA
agaaccaatatgctct

SEQ ID NO: 1495 - DNA, 16 bp, synthetic construct
  source 1..16: mol_type = other DNA
cggcactcagctgcag

SEQ ID NO: 1496 - DNA, 16 bp, synthetic construct
  source 1..16: mol_type = other DNA
gtctaccacatacgca

SEQ ID NO: 1497 - DNA, 16 bp, synthetic construct
  source 1..16: mol_type = other DNA
gttacatcacccactt

SEQ ID NO: 1498 - DNA, 16 bp, synthetic construct
  source 1..16: mol_type = other DNA
atatactgtcccagca

SEQ ID NO: 1499 - DNA, 16 bp, synthetic construct
  source 1..16: mol_type = other DNA
tcttcatccttggtgc

SEQ ID NO: 1500 - DNA, 16 bp, synthetic construct
  source 1..16: mol_type = other DNA
aatgtcctaggatgtt

SEQ ID NO: 1501 - DNA, 16 bp, synthetic construct
  source 1..16: mol_type = other DNA
cgatgtggccatgatt

SEQ ID NO: 1502 - DNA, 16 bp, synthetic construct
  source 1..16: mol_type = other DNA
caatatgggatgaggt

SEQ ID NO: 1503 - DNA, 16 bp, synthetic construct
  source 1..16: mol_type = other DNA
gttctgatgtcagacc

SEQ ID NO: 1504 - DNA, 16 bp, synthetic construct
  source 1..16: mol_type = other DNA
tttggtgaacccagta

SEQ ID NO: 1505 - DNA, 16 bp, synthetic construct
  source 1..16: mol_type = other DNA
ttcttacgacttcatc

SEQ ID NO: 1506 - DNA, 16 bp, synthetic construct
  source 1..16: mol_type = other DNA
tacgatggaacaaaaa

SEQ ID NO: 1507 - DNA, 16 bp, synthetic construct
  source 1..16: mol_type = other DNA
tacgatttaaaatcgc

SEQ ID NO: 1508 - DNA, 16 bp, synthetic construct
  source 1..16: mol_type = other DNA
tgattttgtggccaac

SEQ ID NO: 1509 - DNA, 16 bp, synthetic construct
  source 1..16: mol_type = other DNA
tcgaaactattcatat

SEQ ID NO: 1510 - DNA, 16 bp, synthetic construct
  source 1..16: mol_type = other DNA
ctgctagtgccaaacc

SEQ ID NO: 1511 - DNA, 16 bp, synthetic construct
  source 1..16: mol_type = other DNA
gtatgtttatgtaagc

SEQ ID NO: 1512 - DNA, 16 bp, synthetic construct
  source 1..16: mol_type = other DNA
accttccctgtgtaaa

SEQ ID NO: 1513 - DNA, 16 bp, synthetic construct
  source 1..16: mol_type = other DNA
agattggaatgctact

SEQ ID NO: 1514 - DNA, 16 bp, synthetic construct
  source 1..16: mol_type = other DNA
gtgttcttgttgatat

SEQ ID NO: 1515 - DNA, 16 bp, synthetic construct
  source 1..16: mol_type = other DNA
agataaagctgcctgc

SEQ ID NO: 1516 - DNA, 16 bp, synthetic construct
  source 1..16: mol_type = other DNA
caccgttttgggctaa

SEQ ID NO: 1517 - DNA, 16 bp, synthetic construct
  source 1..16: mol_type = other DNA
ggacttcagagttata

SEQ ID NO: 1518 - DNA, 16 bp, synthetic construct
  source 1..16: mol_type = other DNA
tatcttataagactat

SEQ ID NO: 1519 - DNA, 16 bp, synthetic construct
  source 1..16: mol_type = other DNA
ggaccaaggatatatg

SEQ ID NO: 1520 - DNA, 16 bp, synthetic construct
  source 1..16: mol_type = other DNA
tctcttgggtccattg

SEQ ID NO: 1521 - DNA, 16 bp, synthetic construct
  source 1..16: mol_type = other DNA
gattagtcttgatgta

SEQ ID NO: 1522 - DNA, 16 bp, synthetic construct
  source 1..16: mol_type = other DNA
accttattaatatccc

SEQ ID NO: 1523 - DNA, 16 bp, synthetic construct
  source 1..16: mol_type = other DNA
gttcttaattacattc

SEQ ID NO: 1524 - DNA, 16 bp, synthetic construct
  source 1..16: mol_type = other DNA
cactaaaggtttctgt

SEQ ID NO: 1525 - DNA, 16 bp, synthetic construct
  source 1..16: mol_type = other DNA
tcattcgaatttcttc

SEQ ID NO: 1526 - DNA, 16 bp, synthetic construct
  source 1..16: mol_type = other DNA
gagtgaatcattcagt

SEQ ID NO: 1527 - DNA, 16 bp, synthetic construct
  source 1..16: mol_type = other DNA
aacagtttagattgca

SEQ ID NO: 1528 - DNA, 16 bp, synthetic construct
  source 1..16: mol_type = other DNA
ctgatttagttggtag

SEQ ID NO: 1529 - DNA, 16 bp, synthetic construct
  source 1..16: mol_type = other DNA
tttagggcaaaccttg

SEQ ID NO: 1530 - DNA, 16 bp, synthetic construct
  source 1..16: mol_type = other DNA
taaccataggacatgg

SEQ ID NO: 1531 - DNA, 16 bp, synthetic construct
  source 1..16: mol_type = other DNA
agtaattctaaactag

SEQ ID NO: 1532 - DNA, 16 bp, synthetic construct
  source 1..16: mol_type = other DNA
aaattggcctcctggg

SEQ ID NO: 1533 - DNA, 16 bp, synthetic construct
  source 1..16: mol_type = other DNA
ataatgggcagagctg

SEQ ID NO: 1534 - DNA, 16 bp, synthetic construct
  source 1..16: mol_type = other DNA
ttattgtagggattga

SEQ ID NO: 1535 - DNA, 16 bp, synthetic construct
  source 1..16: mol_type = other DNA
gccaagggaacactgt

SEQ ID NO: 1536 - DNA, 16 bp, synthetic construct
  source 1..16: mol_type = other DNA
gaagtatgtgaactcc

SEQ ID NO: 1537 - DNA, 16 bp, synthetic construct
  source 1..16: mol_type = other DNA
attacttctgatgtcc

SEQ ID NO: 1538 - DNA, 16 bp, synthetic construct
  source 1..16: mol_type = other DNA
aatattgaggcactgg

SEQ ID NO: 1539 - DNA, 16 bp, synthetic construct
  source 1..16: mol_type = other DNA
aggtagctaatgtatg

SEQ ID NO: 1540 - DNA, 16 bp, synthetic construct
  source 1..16: mol_type = other DNA
cactaatgaatcatga

SEQ ID NO: 1541 - DNA, 16 bp, synthetic construct
  source 1..16: mol_type = other DNA
cactaatctcagtact

SEQ ID NO: 1542 - DNA, 16 bp, synthetic construct
  source 1..16: mol_type = other DNA
atacttaccaatatgg

SEQ ID NO: 1543 - DNA, 16 bp, synthetic construct
  source 1..16: mol_type = other DNA
atggaaacatgcttgg

SEQ ID NO: 1544 - DNA, 16 bp, synthetic construct
  source 1..16: mol_type = other DNA
caatggttgatagttt

SEQ ID NO: 1545 - DNA, 16 bp, synthetic construct
  source 1..16: mol_type = other DNA
gagtataaatggcaat

SEQ ID NO: 1546 - DNA, 16 bp, synthetic construct
  source 1..16: mol_type = other DNA
ctattagttggcctgc

SEQ ID NO: 1547 - DNA, 16 bp, synthetic construct
  source 1..16: mol_type = other DNA
gttcttatccacacct

SEQ ID NO: 1548 - DNA, 16 bp, synthetic construct
  source 1..16: mol_type = other DNA
taaaaaattggtttcg

SEQ ID NO: 1549 - DNA, 16 bp, synthetic construct
  source 1..16: mol_type = other DNA
actatcagaacagttc

SEQ ID NO: 1550 - DNA, 16 bp, synthetic construct
  source 1..16: mol_type = other DNA
gtttttattgggccca

SEQ ID NO: 1551 - DNA, 16 bp, synthetic construct
  source 1..16: mol_type = other DNA
caatctagcaacctct

SEQ ID NO: 1552 - DNA, 16 bp, synthetic construct
  source 1..16: mol_type = other DNA
agcaagccaacagaga

SEQ ID NO: 1553 - DNA, 16 bp, synthetic construct
  source 1..16: mol_type = other DNA
cttagtgtagaattgt

SEQ ID NO: 1554 - DNA, 16 bp, synthetic construct
  source 1..16: mol_type = other DNA
aattatttcttgcgag

SEQ ID NO: 1555 - DNA, 16 bp, synthetic construct
  source 1..16: mol_type = other DNA
aattctatagctaagt

SEQ ID NO: 1556 - DNA, 16 bp, synthetic construct
  source 1..16: mol_type = other DNA
ggcattagatggtaag

SEQ ID NO: 1557 - DNA, 16 bp, synthetic construct
  source 1..16: mol_type = other DNA
gccataatctgtgatt

SEQ ID NO: 1558 - DNA, 16 bp, synthetic construct
  source 1..16: mol_type = other DNA
agttagaatagtcttc

SEQ ID NO: 1559 - DNA, 16 bp, synthetic construct
  source 1..16: mol_type = other DNA
attgaatagccatgta

SEQ ID NO: 1560 - DNA, 16 bp, synthetic construct
  source 1..16: mol_type = other DNA
tatgaagttagtatag

SEQ ID NO: 1561 - DNA, 16 bp, synthetic construct
  source 1..16: mol_type = other DNA
tatatacctgttgcct

SEQ ID NO: 1562 - DNA, 16 bp, synthetic construct
  source 1..16: mol_type = other DNA
atgagtaggcaactga

SEQ ID NO: 1563 - DNA, 16 bp, synthetic construct
  source 1..16: mol_type = other DNA
ctattatgcactctat

SEQ ID NO: 1564 - DNA, 16 bp, synthetic construct
  source 1..16: mol_type = other DNA
cactgatacataccac

SEQ ID NO: 1565 - DNA, 16 bp, synthetic construct
  source 1..16: mol_type = other DNA
gcatcaagacattcta

SEQ ID NO: 1566 - DNA, 16 bp, synthetic construct
  source 1..16: mol_type = other DNA
tatagtaatcacaagt

SEQ ID NO: 1567 - DNA, 16 bp, synthetic construct
  source 1..16: mol_type = other DNA
ttagaatacgctgaga

SEQ ID NO: 1568 - DNA, 16 bp, synthetic construct
  source 1..16: mol_type = other DNA
gttcagtccttgtgta

SEQ ID NO: 1569 - DNA, 16 bp, synthetic construct
  source 1..16: mol_type = other DNA
agtaggagtagatgat

SEQ ID NO: 1570 - DNA, 16 bp, synthetic construct
  source 1..16: mol_type = other DNA
gaacaatctccccagc

SEQ ID NO: 1571 - DNA, 16 bp, synthetic construct
  source 1..16: mol_type = other DNA
cagaaccaatatgctc

SEQ ID NO: 1572 - DNA, 16 bp, synthetic construct
  source 1..16: mol_type = other DNA
tcggcactcagctgca

SEQ ID NO: 1573 - DNA, 16 bp, synthetic construct
  source 1..16: mol_type = other DNA
agtctaccacatacgc

SEQ ID NO: 1574 - DNA, 16 bp, synthetic construct
  source 1..16: mol_type = other DNA
tgttacatcacccact

SEQ ID NO: 1575 - DNA, 16 bp, synthetic construct
  source 1..16: mol_type = other DNA
gatatactgtcccagc

SEQ ID NO: 1576 - DNA, 16 bp, synthetic construct
  source 1..16: mol_type = other DNA
ctcttcatccttggtg

SEQ ID NO: 1577 - DNA, 16 bp, synthetic construct
  source 1..16: mol_type = other DNA
aaatgtcctaggatgt

SEQ ID NO: 1578 - DNA, 16 bp, synthetic construct
  source 1..16: mol_type = other DNA
acgatgtggccatgat

SEQ ID NO: 1579 - DNA, 16 bp, synthetic construct
  source 1..16: mol_type = other DNA
acaatatgggatgagg

SEQ ID NO: 1580 - DNA, 16 bp, synthetic construct
  source 1..16: mol_type = other DNA
agttctgatgtcagac

SEQ ID NO: 1581 - DNA, 16 bp, synthetic construct
  source 1..16: mol_type = other DNA
taatcttgtgcttgga

SEQ ID NO: 1582 - DNA, 16 bp, synthetic construct
  source 1..16: mol_type = other DNA
cttcttacgacttcat

SEQ ID NO: 1583 - DNA, 16 bp, synthetic construct
  source 1..16: mol_type = other DNA
atacgatggaacaaaa

SEQ ID NO: 1584 - DNA, 16 bp, synthetic construct
  source 1..16: mol_type = other DNA
atacgatttaaaatcg

SEQ ID NO: 1585 - DNA, 16 bp, synthetic construct
  source 1..16: mol_type = other DNA
ggagcttatttattca

SEQ ID NO: 1586 - DNA, 16 bp, synthetic construct
  source 1..16: mol_type = other DNA
ttcgaaactattcata

SEQ ID NO: 1587 - DNA, 16 bp, synthetic construct
  source 1..16: mol_type = other DNA
gctgctagtgccaaac

SEQ ID NO: 1588 - DNA, 16 bp, synthetic construct
  source 1..16: mol_type = other DNA
gtccacctttaaatgg

SEQ ID NO: 1589 - DNA, 16 bp, synthetic construct
  source 1..16: mol_type = other DNA
aaccttccctgtgtaa

SEQ ID NO: 1590 - DNA, 16 bp, synthetic construct
  source 1..16: mol_type = other DNA
cagattggaatgctac

SEQ ID NO: 1591 - DNA, 16 bp, synthetic construct
  source 1..16: mol_type = other DNA
tgtgttcttgttgata

SEQ ID NO: 1592 - DNA, 16 bp, synthetic construct
  source 1..16: mol_type = other DNA
gagataaagctgcctg

SEQ ID NO: 1593 - DNA, 16 bp, synthetic construct
  source 1..16: mol_type = other DNA
gcaccgttttgggcta

SEQ ID NO: 1594 - DNA, 16 bp, synthetic construct
  source 1..16: mol_type = other DNA
ggtggacttcagagtt

SEQ ID NO: 1595 - DNA, 16 bp, synthetic construct
  source 1..16: mol_type = other DNA
gtatcttataagacta

SEQ ID NO: 1596 - DNA, 16 bp, synthetic construct
  source 1..16: mol_type = other DNA
gggaccaaggatatat

SEQ ID NO: 1597 - DNA, 16 bp, synthetic construct
  source 1..16: mol_type = other DNA
agtacagttccttttc

SEQ ID NO: 1598 - DNA, 16 bp, synthetic construct
  source 1..16: mol_type = other DNA
ttctcttgggtccatt

SEQ ID NO: 1599 - DNA, 16 bp, synthetic construct
  source 1..16: mol_type = other DNA
agattagtcttgatgt

SEQ ID NO: 1600 - DNA, 16 bp, synthetic construct
  source 1..16: mol_type = other DNA
caccttattaatatcc

SEQ ID NO: 1601 - DNA, 16 bp, synthetic construct
  source 1..16: mol_type = other DNA
gcttagttcttaatta

SEQ ID NO: 1602 - DNA, 16 bp, synthetic construct
  source 1..16: mol_type = other DNA
gcactaaaggtttctg

SEQ ID NO: 1603 - DNA, 16 bp, synthetic construct
  source 1..16: mol_type = other DNA
ttcattcgaatttctt

SEQ ID NO: 1604 - DNA, 16 bp, synthetic construct
  source 1..16: mol_type = other DNA
ccttagagtgaatcat

SEQ ID NO: 1605 - DNA, 16 bp, synthetic construct
  source 1..16: mol_type = other DNA
caacagtttagattgc

SEQ ID NO: 1606 - DNA, 16 bp, synthetic construct
  source 1..16: mol_type = other DNA
actgatttagttggta

SEQ ID NO: 1607 - DNA, 16 bp, synthetic construct
  source 1..16: mol_type = other DNA
atttagggcaaacctt

SEQ ID NO: 1608 - DNA, 16 bp, synthetic construct
  source 1..16: mol_type = other DNA
ataaccataggacatg

SEQ ID NO: 1609 - DNA, 16 bp, synthetic construct
  source 1..16: mol_type = other DNA
ctaagtagtaattcta

SEQ ID NO: 1610 - DNA, 16 bp, synthetic construct
  source 1..16: mol_type = other DNA
aaaaattggcctcctg

SEQ ID NO: 1611 - DNA, 16 bp, synthetic construct
  source 1..16: mol_type = other DNA
aataatgggcagagct

SEQ ID NO: 1612 - DNA, 16 bp, synthetic construct
  source 1..16: mol_type = other DNA
gttattgtagggattg

SEQ ID NO: 1613 - DNA, 16 bp, synthetic construct
  source 1..16: mol_type = other DNA
caagacagactgttga

SEQ ID NO: 1614 - DNA, 16 bp, synthetic construct
  source 1..16: mol_type = other DNA
agaagtatgtgaactc

SEQ ID NO: 1615 - DNA, 16 bp, synthetic construct
  source 1..16: mol_type = other DNA
gtaattacttctgatg

SEQ ID NO: 1616 - DNA, 16 bp, synthetic construct
  source 1..16: mol_type = other DNA
taatattgaggcactg

SEQ ID NO: 1617 - DNA, 16 bp, synthetic construct
  source 1..16: mol_type = other DNA
tataggtagctaatgt

SEQ ID NO: 1618 - DNA, 16 bp, synthetic construct
  source 1..16: mol_type = other DNA
acactaatgaatcatg

SEQ ID NO: 1619 - DNA, 16 bp, synthetic construct
  source 1..16: mol_type = other DNA
acactaatctcagtac

SEQ ID NO: 1620 - DNA, 16 bp, synthetic construct
  source 1..16: mol_type = other DNA
gatacttaccaatatg

SEQ ID NO: 1621 - DNA, 16 bp, synthetic construct
  source 1..16: mol_type = other DNA
ctgtaggttttgcttc

SEQ ID NO: 1622 - DNA, 16 bp, synthetic construct
  source 1..16: mol_type = other DNA
gacaatggttgatagt

SEQ ID NO: 1623 - DNA, 16 bp, synthetic construct
  source 1..16: mol_type = other DNA
gccaaaaatcagccac

SEQ ID NO: 1624 - DNA, 16 bp, synthetic construct
  source 1..16: mol_type = other DNA
tctattagttggcctg

SEQ ID NO: 1625 - DNA, 16 bp, synthetic construct
  source 1..16: mol_type = other DNA
aattttcgggttctta

SEQ ID NO: 1626 - DNA, 16 bp, synthetic construct
  source 1..16: mol_type = other DNA
tccagtaaaaaattgg

SEQ ID NO: 1627 - DNA, 16 bp, synthetic construct
  source 1..16: mol_type = other DNA
ccactatcagaacagt

SEQ ID NO: 1628 - DNA, 16 bp, synthetic construct
  source 1..16: mol_type = other DNA
acgaagcctgaatgcc

SEQ ID NO: 1629 - DNA, 16 bp, synthetic construct
  source 1..16: mol_type = other DNA
acaatctagcaacctc

SEQ ID NO: 1630 - DNA, 16 bp, synthetic construct
  source 1..16: mol_type = other DNA
tagcaagccaacagag

SEQ ID NO: 1631 - DNA, 16 bp, synthetic construct
  source 1..16: mol_type = other DNA
cataggcttagtgtag

SEQ ID NO: 1632 - DNA, 16 bp, synthetic construct
  source 1..16: mol_type = other DNA
gaattatttcttgcga

SEQ ID NO: 1633 - DNA, 16 bp, synthetic construct
  source 1..16: mol_type = other DNA
tcaaagcctgttggat

SEQ ID NO: 1634 - DNA, 16 bp, synthetic construct
  source 1..16: mol_type = other DNA
aggcattagatggtaa

SEQ ID NO: 1635 - DNA, 16 bp, synthetic construct
  source 1..16: mol_type = other DNA
tacttacttctgtagt

SEQ ID NO: 1636 - DNA, 16 bp, synthetic construct
  source 1..16: mol_type = other DNA
tagttagaatagtctt

SEQ ID NO: 1637 - DNA, 16 bp, synthetic construct
  source 1..16: mol_type = other DNA
gtaaattgaatagcca

SEQ ID NO: 1638 - DNA, 16 bp, synthetic construct
  source 1..16: mol_type = other DNA
cttatgaagttagtat

SEQ ID NO: 1639 - DNA, 16 bp, synthetic construct
  source 1..16: mol_type = other DNA
atatatacctgttgcc

SEQ ID NO: 1640 - DNA, 16 bp, synthetic construct
  source 1..16: mol_type = other DNA
gatgagtaggcaactg

SEQ ID NO: 1641 - DNA, 16 bp, synthetic construct
  source 1..16: mol_type = other DNA
tctattatgcactcta

SEQ ID NO: 1642 - DNA, 16 bp, synthetic construct
  source 1..16: mol_type = other DNA
gttcaaattggatgca

SEQ ID NO: 1643 - DNA, 16 bp, synthetic construct
  source 1..16: mol_type = other DNA
tctgattacagcatca

SEQ ID NO: 1644 - DNA, 16 bp, synthetic construct
  source 1..16: mol_type = other DNA
ctatagtaatcacaag

SEQ ID NO: 1645 - DNA, 16 bp, synthetic construct
  source 1..16: mol_type = other DNA
tttagaatacgctgag

SEQ ID NO: 1646 - DNA, 16 bp, synthetic construct
  source 1..16: mol_type = other DNA
ggttcagtccttgtgt

SEQ ID NO: 1647 - DNA, 16 bp, synthetic construct
  source 1..16: mol_type = other DNA
aagtaggagtagatga

SEQ ID NO: 1648 - DNA, 16 bp, synthetic construct
  source 1..16: mol_type = other DNA
tgagaacaatctcccc

SEQ ID NO: 1649 - DNA, 16 bp, synthetic construct
  source 1..16: mol_type = other DNA
acagaaccaatatgct

SEQ ID NO: 1650 - DNA, 16 bp, synthetic construct
  source 1..16: mol_type = other DNA
ttcggcactcagctgc

SEQ ID NO: 1651 - DNA, 16 bp, synthetic construct
  source 1..16: mol_type = other DNA
gatagatctcttctct

SEQ ID NO: 1652 - DNA, 16 bp, synthetic construct
  source 1..16: mol_type = other DNA
ttgttacatcacccac

SEQ ID NO: 1653 - DNA, 16 bp, synthetic construct
  source 1..16: mol_type = other DNA
ggatatactgtcccag

SEQ ID NO: 1654 - DNA, 16 bp, synthetic construct
  source 1..16: mol_type = other DNA
ggtaatctcttcatcc

SEQ ID NO: 1655 - DNA, 16 bp, synthetic construct
  source 1..16: mol_type = other DNA
aaaatgtcctaggatg

SEQ ID NO: 1656 - DNA, 16 bp, synthetic construct
  source 1..16: mol_type = other DNA
gacgatgtggccatga

SEQ ID NO: 1657 - DNA, 16 bp, synthetic construct
  source 1..16: mol_type = other DNA
aacaatatgggatgag

SEQ ID NO: 1658 - DNA, 16 bp, synthetic construct
  source 1..16: mol_type = other DNA
aagttctgatgtcaga

SEQ ID NO: 1659 - DNA, 16 bp, synthetic construct
  source 1..16: mol_type = other DNA
ataatcttgtgcttgg

SEQ ID NO: 1660 - DNA, 16 bp, synthetic construct
  source 1..16: mol_type = other DNA
acttcttacgacttca

SEQ ID NO: 1661 - DNA, 16 bp, synthetic construct
  source 1..16: mol_type = other DNA
tatacgatggaacaaa

SEQ ID NO: 1662 - DNA, 16 bp, synthetic construct
  source 1..16: mol_type = other DNA
catacgatttaaaatc

SEQ ID NO: 1663 - DNA, 16 bp, synthetic construct
  source 1..16: mol_type = other DNA
tggagcttatttattc

SEQ ID NO: 1664 - DNA, 16 bp, synthetic construct
  source 1..16: mol_type = other DNA
attcgaaactattcat

SEQ ID NO: 1665 - DNA, 16 bp, synthetic construct
  source 1..16: mol_type = other DNA
tgctgctagtgccaaa

SEQ ID NO: 1666 - DNA, 16 bp, synthetic construct
  source 1..16: mol_type = other DNA
tgtccacctttaaatg

SEQ ID NO: 1667 - DNA, 16 bp, synthetic construct
  source 1..16: mol_type = other DNA
aaaccttccctgtgta

SEQ ID NO: 1668 - DNA, 16 bp, synthetic construct
  source 1..16: mol_type = other DNA
acagattggaatgcta

SEQ ID NO: 1669 - DNA, 16 bp, synthetic construct
  source 1..16: mol_type = other DNA
gtgcactcattctgtg

SEQ ID NO: 1670 - DNA, 16 bp, synthetic construct
  source 1..16: mol_type = other DNA
ttgagataaagctgcc

SEQ ID NO: 1671 - DNA, 16 bp, synthetic construct
  source 1..16: mol_type = other DNA
tgcaccgttttgggct

SEQ ID NO: 1672 - DNA, 16 bp, synthetic construct
  source 1..16: mol_type = other DNA
tggtggacttcagagt

SEQ ID NO: 1673 - DNA, 16 bp, synthetic construct
  source 1..16: mol_type = other DNA
tgtatcttataagact

SEQ ID NO: 1674 - DNA, 16 bp, synthetic construct
  source 1..16: mol_type = other DNA
tgggaccaaggatata

SEQ ID NO: 1675 - DNA, 16 bp, synthetic construct
  source 1..16: mol_type = other DNA
cagtacagttcctttt

SEQ ID NO: 1676 - DNA, 16 bp, synthetic construct
  source 1..16: mol_type = other DNA
cttctcttgggtccat

SEQ ID NO: 1677 - DNA, 16 bp, synthetic construct
  source 1..16: mol_type = other DNA
aagattagtcttgatg

SEQ ID NO: 1678 - DNA, 16 bp, synthetic construct
  source 1..16: mol_type = other DNA
tcaccttattaatatc

SEQ ID NO: 1679 - DNA, 16 bp, synthetic construct
  source 1..16: mol_type = other DNA
aaaatcgctgcttagt

SEQ ID NO: 1680 - DNA, 16 bp, synthetic construct
  source 1..16: mol_type = other DNA
ggcactaaaggtttct

SEQ ID NO: 1681 - DNA, 16 bp, synthetic construct
  source 1..16: mol_type = other DNA
gttcattcgaatttct

SEQ ID NO: 1682 - DNA, 16 bp, synthetic construct
  source 1..16: mol_type = other DNA
agccttagagtgaatc

SEQ ID NO: 1683 - DNA, 16 bp, synthetic construct
  source 1..16: mol_type = other DNA
cccaacgcaacagttt

SEQ ID NO: 1684 - DNA, 16 bp, synthetic construct
  source 1..16: mol_type = other DNA
aataggagagtctttc

SEQ ID NO: 1685 - DNA, 16 bp, synthetic construct
  source 1..16: mol_type = other DNA
tatttagggcaaacct

SEQ ID NO: 1686 - DNA, 16 bp, synthetic construct
  source 1..16: mol_type = other DNA
cataaccataggacat

SEQ ID NO: 1687 - DNA, 16 bp, synthetic construct
  source 1..16: mol_type = other DNA
gctaagtagtaattct

SEQ ID NO: 1688 - DNA, 16 bp, synthetic construct
  source 1..16: mol_type = other DNA
gattagttaacctttt

SEQ ID NO: 1689 - DNA, 16 bp, synthetic construct
  source 1..16: mol_type = other DNA
taataatgggcagagc

SEQ ID NO: 1690 - DNA, 16 bp, synthetic construct
  source 1..16: mol_type = other DNA
acagagttattgtagg

SEQ ID NO: 1691 - DNA, 16 bp, synthetic construct
  source 1..16: mol_type = other DNA
attgtatgaggtctct

SEQ ID NO: 1692 - DNA, 16 bp, synthetic construct
  source 1..16: mol_type = other DNA
cagaagtatgtgaact

SEQ ID NO: 1693 - DNA, 16 bp, synthetic construct
  source 1..16: mol_type = other DNA
ctatatacatccaagt

SEQ ID NO: 1694 - DNA, 16 bp, synthetic construct
  source 1..16: mol_type = other DNA
ctaatattgaggcact

SEQ ID NO: 1695 - DNA, 16 bp, synthetic construct
  source 1..16: mol_type = other DNA
gctataggtagctaat

SEQ ID NO: 1696 - DNA, 16 bp, synthetic construct
  source 1..16: mol_type = other DNA
cacactaatgaatcat

SEQ ID NO: 1697 - DNA, 16 bp, synthetic construct
  source 1..16: mol_type = other DNA
caacactaatctcagt

SEQ ID NO: 1698 - DNA, 16 bp, synthetic construct
  source 1..16: mol_type = other DNA
ataacatggctggcat

SEQ ID NO: 1699 - DNA, 16 bp, synthetic construct
  source 1..16: mol_type = other DNA
catagacatgtgttca

SEQ ID NO: 1700 - DNA, 16 bp, synthetic construct
  source 1..16: mol_type = other DNA
tgacaatggttgatag

SEQ ID NO: 1701 - DNA, 16 bp, synthetic construct
  source 1..16: mol_type = other DNA
gtatcatttggcttaa

SEQ ID NO: 1702 - DNA, 16 bp, synthetic construct
  source 1..16: mol_type = other DNA
ttctattagttggcct

SEQ ID NO: 1703 - DNA, 16 bp, synthetic construct
  source 1..16: mol_type = other DNA
taattttcgggttctt

SEQ ID NO: 1704 - DNA, 16 bp, synthetic construct
  source 1..16: mol_type = other DNA
ggattaattcccttcc

SEQ ID NO: 1705 - DNA, 16 bp, synthetic construct
  source 1..16: mol_type = other DNA
gatagagcacatggcc

SEQ ID NO: 1706 - DNA, 16 bp, synthetic construct
  source 1..16: mol_type = other DNA
cacgaagcctgaatgc

SEQ ID NO: 1707 - DNA, 16 bp, synthetic construct
  source 1..16: mol_type = other DNA
cacaatctagcaacct

SEQ ID NO: 1708 - DNA, 16 bp, synthetic construct
  source 1..16: mol_type = other DNA
gaatagcaagccaaca

SEQ ID NO: 1709 - DNA, 16 bp, synthetic construct
  source 1..16: mol_type = other DNA
acataggcttagtgta

SEQ ID NO: 1710 - DNA, 16 bp, synthetic construct
  source 1..16: mol_type = other DNA
cgaattatttcttgcg

SEQ ID NO: 1711 - DNA, 16 bp, synthetic construct
  source 1..16: mol_type = other DNA
ctcaaagcctgttgga

SEQ ID NO: 1712 - DNA, 16 bp, synthetic construct
  source 1..16: mol_type = other DNA
aaaatggtggcgaggc

SEQ ID NO: 1713 - DNA, 16 bp, synthetic construct
  source 1..16: mol_type = other DNA
gtacttacttctgtag

SEQ ID NO: 1714 - DNA, 16 bp, synthetic construct
  source 1..16: mol_type = other DNA
ttagttagaatagtct

SEQ ID NO: 1715 - DNA, 16 bp, synthetic construct
  source 1..16: mol_type = other DNA
agtaaattgaatagcc

SEQ ID NO: 1716 - DNA, 16 bp, synthetic construct
  source 1..16: mol_type = other DNA
gcttatgaagttagta

SEQ ID NO: 1717 - DNA, 16 bp, synthetic construct
  source 1..16: mol_type = other DNA
cgtaaaattgtgtctc

SEQ ID NO: 1718 - DNA, 16 bp, synthetic construct
  source 1..16: mol_type = other DNA
gcataagagatgagta

SEQ ID NO: 1719 - DNA, 16 bp, synthetic construct
  source 1..16: mol_type = other DNA
atctattatgcactct

SEQ ID NO: 1720 - DNA, 16 bp, synthetic construct
  source 1..16: mol_type = other DNA
catagttcaaattgga

SEQ ID NO: 1721 - DNA, 16 bp, synthetic construct
  source 1..16: mol_type = other DNA
gggaaaaagtgtgttc

SEQ ID NO: 1722 - DNA, 16 bp, synthetic construct
  source 1..16: mol_type = other DNA
gtaattgctatagtaa

SEQ ID NO: 1723 - DNA, 16 bp, synthetic construct
  source 1..16: mol_type = other DNA
atttagaatacgctga

SEQ ID NO: 1724 - DNA, 16 bp, synthetic construct
  source 1..16: mol_type = other DNA
tggttcagtccttgtg

SEQ ID NO: 1725 - DNA, 16 bp, synthetic construct
  source 1..16: mol_type = other DNA
caagtaggagtagatg

SEQ ID NO: 1726 - DNA, 16 bp, synthetic construct
  source 1..16: mol_type = other DNA
atgagaacaatctccc

SEQ ID NO: 1727 - DNA, 16 bp, synthetic construct
  source 1..16: mol_type = other DNA
cacagaaccaatatgc

SEQ ID NO: 1728 - DNA, 16 bp, synthetic construct
  source 1..16: mol_type = other DNA
tttcggcactcagctg

SEQ ID NO: 1729 - DNA, 16 bp, synthetic construct
  source 1..16: mol_type = other DNA
cgatagatctcttctc

SEQ ID NO: 1730 - DNA, 16 bp, synthetic construct
  source 1..16: mol_type = other DNA
gattgttacatcaccc

SEQ ID NO: 1731 - DNA, 16 bp, synthetic construct
  source 1..16: mol_type = other DNA
tggatatactgtccca

SEQ ID NO: 1732 - DNA, 16 bp, synthetic construct
  source 1..16: mol_type = other DNA
tggtaatctcttcatc

SEQ ID NO: 1733 - DNA, 16 bp, synthetic construct
  source 1..16: mol_type = other DNA
ccaaaaatgtcctagg

SEQ ID NO: 1734 - DNA, 16 bp, synthetic construct
  source 1..16: mol_type = other DNA
tgtgacgatgtggcca

SEQ ID NO: 1735 - DNA, 16 bp, synthetic construct
  source 1..16: mol_type = other DNA
gaacaatatgggatga

SEQ ID NO: 1736 - DNA, 16 bp, synthetic construct
  source 1..16: mol_type = other DNA
gaagttctgatgtcag

SEQ ID NO: 1737 - DNA, 16 bp, synthetic construct
  source 1..16: mol_type = other DNA
cataatcttgtgcttg

SEQ ID NO: 1738 - DNA, 16 bp, synthetic construct
  source 1..16: mol_type = other DNA
gacttcttacgacttc

SEQ ID NO: 1739 - DNA, 16 bp, synthetic construct
  source 1..16: mol_type = other DNA
atatacgatggaacaa

SEQ ID NO: 1740 - DNA, 16 bp, synthetic construct
  source 1..16: mol_type = other DNA
gcatacgatttaaaat

SEQ ID NO: 1741 - DNA, 16 bp, synthetic construct
  source 1..16: mol_type = other DNA
gctggagcttatttat

SEQ ID NO: 1742 - DNA, 16 bp, synthetic construct
  source 1..16: mol_type = other DNA
gattcgaaactattca

SEQ ID NO: 1743 - DNA, 16 bp, synthetic construct
  source 1..16: mol_type = other DNA
ctgctgctagtgccaa

SEQ ID NO: 1744 - DNA, 16 bp, synthetic construct
  source 1..16: mol_type = other DNA
gcttttgtccaccttt

SEQ ID NO: 1745 - DNA, 16 bp, synthetic construct
  source 1..16: mol_type = other DNA
taaaccttccctgtgt

SEQ ID NO: 1746 - DNA, 16 bp, synthetic construct
  source 1..16: mol_type = other DNA
tacagattggaatgct

SEQ ID NO: 1747 - DNA, 16 bp, synthetic construct
  source 1..16: mol_type = other DNA
tgtgcactcattctgt

SEQ ID NO: 1748 - DNA, 16 bp, synthetic construct
  source 1..16: mol_type = other DNA
gttgagataaagctgc

SEQ ID NO: 1749 - DNA, 16 bp, synthetic construct
  source 1..16: mol_type = other DNA
ttgcaccgttttgggc

SEQ ID NO: 1750 - DNA, 16 bp, synthetic construct
  source 1..16: mol_type = other DNA
ttggtggacttcagag

SEQ ID NO: 1751 - DNA, 16 bp, synthetic construct
  source 1..16: mol_type = other DNA
atgtatcttataagac

SEQ ID NO: 1752 - DNA, 16 bp, synthetic construct
  source 1..16: mol_type = other DNA
ctgggaccaaggatat

SEQ ID NO: 1753 - DNA, 16 bp, synthetic construct
  source 1..16: mol_type = other DNA
ccagtacagttccttt

SEQ ID NO: 1754 - DNA, 16 bp, synthetic construct
  source 1..16: mol_type = other DNA
tcttctcttgggtcca

SEQ ID NO: 1755 - DNA, 16 bp, synthetic construct
  source 1..16: mol_type = other DNA
caagattagtcttgat

SEQ ID NO: 1756 - DNA, 16 bp, synthetic construct
  source 1..16: mol_type = other DNA
taccttattaatatcc

SEQ ID NO: 1757 - DNA, 16 bp, synthetic construct
  source 1..16: mol_type = other DNA
aaaaatcgctgcttag

SEQ ID NO: 1758 - DNA, 16 bp, synthetic construct
  source 1..16: mol_type = other DNA
gactacggactggcaa

SEQ ID NO: 1759 - DNA, 16 bp, synthetic construct
  source 1..16: mol_type = other DNA
agaaagttcattcgaa

SEQ ID NO: 1760 - DNA, 16 bp, synthetic construct
  source 1..16: mol_type = other DNA
ttacagccttagagtg

SEQ ID NO: 1761 - DNA, 16 bp, synthetic construct
  source 1..16: mol_type = other DNA
tttgaaccgtattccc

SEQ ID NO: 1762 - DNA, 16 bp, synthetic construct
  source 1..16: mol_type = other DNA
gaataggagagtcttt

SEQ ID NO: 1763 - DNA, 16 bp, synthetic construct
  source 1..16: mol_type = other DNA
attgagatgacagtgg

SEQ ID NO: 1764 - DNA, 16 bp, synthetic construct
  source 1..16: mol_type = other DNA
ccataaccataggaca

SEQ ID NO: 1765 - DNA, 16 bp, synthetic construct
  source 1..16: mol_type = other DNA
tgctaagtagtaattc

SEQ ID NO: 1766 - DNA, 16 bp, synthetic construct
  source 1..16: mol_type = other DNA
aagattagttaacctt

SEQ ID NO: 1767 - DNA, 16 bp, synthetic construct
  source 1..16: mol_type = other DNA
caataataatgggcag

SEQ ID NO: 1768 - DNA, 16 bp, synthetic construct
  source 1..16: mol_type = other DNA
gagtcataatttgctt

SEQ ID NO: 1769 - DNA, 16 bp, synthetic construct
  source 1..16: mol_type = other DNA
ctattgtatgaggtct

SEQ ID NO: 1770 - DNA, 16 bp, synthetic construct
  source 1..16: mol_type = other DNA
ccagaagtatgtgaac

SEQ ID NO: 1771 - DNA, 16 bp, synthetic construct
  source 1..16: mol_type = other DNA
cctatatacatccaag

SEQ ID NO: 1772 - DNA, 16 bp, synthetic construct
  source 1..16: mol_type = other DNA
actaatattgaggcac

SEQ ID NO: 1773 - DNA, 16 bp, synthetic construct
  source 1..16: mol_type = other DNA
agctataggtagctaa

SEQ ID NO: 1774 - DNA, 16 bp, synthetic construct
  source 1..16: mol_type = other DNA
ccacactaatgaatca

SEQ ID NO: 1775 - DNA, 16 bp, synthetic construct
  source 1..16: mol_type = other DNA
tatggtaagccccatg

SEQ ID NO: 1776 - DNA, 16 bp, synthetic construct
  source 1..16: mol_type = other DNA
atataacatggctggc

SEQ ID NO: 1777 - DNA, 16 bp, synthetic construct
  source 1..16: mol_type = other DNA
acatagacatgtgttc

SEQ ID NO: 1778 - DNA, 16 bp, synthetic construct
  source 1..16: mol_type = other DNA
ctcaataactgagtta

SEQ ID NO: 1779 - DNA, 16 bp, synthetic construct
  source 1..16: mol_type = other DNA
gagaaggcggtatcat

SEQ ID NO: 1780 - DNA, 16 bp, synthetic construct
  source 1..16: mol_type = other DNA
cttctattagttggcc

SEQ ID NO: 1781 - DNA, 16 bp, synthetic construct
  source 1..16: mol_type = other DNA
ttaattttcgggttct

SEQ ID NO: 1782 - DNA, 16 bp, synthetic construct
  source 1..16: mol_type = other DNA
aggattaattcccttc

SEQ ID NO: 1783 - DNA, 16 bp, synthetic construct
  source 1..16: mol_type = other DNA
ggatagagcacatggc

SEQ ID NO: 1784 - DNA, 16 bp, synthetic construct
  source 1..16: mol_type = other DNA
gtacacgaagcctgaa

SEQ ID NO: 1785 - DNA, 16 bp, synthetic construct
  source 1..16: mol_type = other DNA
tcacaatctagcaacc

SEQ ID NO: 1786 - DNA, 16 bp, synthetic construct
  source 1..16: mol_type = other DNA
tgaatagcaagccaac

SEQ ID NO: 1787 - DNA, 16 bp, synthetic construct
  source 1..16: mol_type = other DNA
aaacataggcttagtg

SEQ ID NO: 1788 - DNA, 16 bp, synthetic construct
  source 1..16: mol_type = other DNA
aatacccttggtggag

SEQ ID NO: 1789 - DNA, 16 bp, synthetic construct
  source 1..16: mol_type = other DNA
taatcatgggacagga

SEQ ID NO: 1790 - DNA, 16 bp, synthetic construct
  source 1..16: mol_type = other DNA
caaaatggtggcgagg

SEQ ID NO: 1791 - DNA, 16 bp, synthetic construct
  source 1..16: mol_type = other DNA
gtatttgggtgttctg

SEQ ID NO: 1792 - DNA, 16 bp, synthetic construct
  source 1..16: mol_type = other DNA
tttagttagaatagtc

SEQ ID NO: 1793 - DNA, 16 bp, synthetic construct
  source 1..16: mol_type = other DNA
gtacaaatttatgcca

SEQ ID NO: 1794 - DNA, 16 bp, synthetic construct
  source 1..16: mol_type = other DNA
ggcttatgaagttagt

SEQ ID NO: 1795 - DNA, 16 bp, synthetic construct
  source 1..16: mol_type = other DNA
taattgcatctgctcg

SEQ ID NO: 1796 - DNA, 16 bp, synthetic construct
  source 1..16: mol_type = other DNA
tgcataagagatgagt

SEQ ID NO: 1797 - DNA, 16 bp, synthetic construct
  source 1..16: mol_type = other DNA
tatctattatgcactc

SEQ ID NO: 1798 - DNA, 16 bp, synthetic construct
  source 1..16: mol_type = other DNA
tcatagttcaaattgg

SEQ ID NO: 1799 - DNA, 16 bp, synthetic construct
  source 1..16: mol_type = other DNA
caattatgaatctgca

SEQ ID NO: 1800 - DNA, 16 bp, synthetic construct
  source 1..16: mol_type = other DNA
agtaattgctatagta

SEQ ID NO: 1801 - DNA, 16 bp, synthetic construct
  source 1..16: mol_type = other DNA
catttagaatacgctg

SEQ ID NO: 1802 - DNA, 16 bp, synthetic construct
  source 1..16: mol_type = other DNA
ctggttcagtccttgt

SEQ ID NO: 1803 - DNA, 16 bp, synthetic construct
  source 1..16: mol_type = other DNA
ccaagtaggagtagat

SEQ ID NO: 1804 - DNA, 16 bp, synthetic construct
  source 1..16: mol_type = other DNA
gtaatgagaacaatct

SEQ ID NO: 1805 - DNA, 16 bp, synthetic construct
  source 1..16: mol_type = other DNA
ccacagaaccaatatg

SEQ ID NO: 1806 - DNA, 16 bp, synthetic construct
  source 1..16: mol_type = other DNA
ttttcggcactcagct

SEQ ID NO: 1807 - DNA, 16 bp, synthetic construct
  source 1..16: mol_type = other DNA
gcgatagatctcttct

SEQ ID NO: 1808 - DNA, 16 bp, synthetic construct
  source 1..16: mol_type = other DNA
cgattgttacatcacc

SEQ ID NO: 1809 - DNA, 16 bp, synthetic construct
  source 1..16: mol_type = other DNA
ctggatatactgtccc

SEQ ID NO: 1810 - DNA, 16 bp, synthetic construct
  source 1..16: mol_type = other DNA
gtcttggtaatctctt

SEQ ID NO: 1811 - DNA, 16 bp, synthetic construct
  source 1..16: mol_type = other DNA
gcttttgtgatccaaa

SEQ ID NO: 1812 - DNA, 16 bp, synthetic construct
  source 1..16: mol_type = other DNA
ctgtgacgatgtggcc

SEQ ID NO: 1813 - DNA, 16 bp, synthetic construct
  source 1..16: mol_type = other DNA
ggaacaatatgggatg

SEQ ID NO: 1814 - DNA, 16 bp, synthetic construct
  source 1..16: mol_type = other DNA
ggcctgaagttctgat

SEQ ID NO: 1815 - DNA, 16 bp, synthetic construct
  source 1..16: mol_type = other DNA
ccataatcttgtgctt

SEQ ID NO: 1816 - DNA, 16 bp, synthetic construct
  source 1..16: mol_type = other DNA
agacttcttacgactt

SEQ ID NO: 1817 - DNA, 16 bp, synthetic construct
  source 1..16: mol_type = other DNA
gatatacgatggaaca

SEQ ID NO: 1818 - DNA, 16 bp, synthetic construct
  source 1..16: mol_type = other DNA
tgcatacgatttaaaa

SEQ ID NO: 1819 - DNA, 16 bp, synthetic construct
  source 1..16: mol_type = other DNA
ggctggagcttattta

SEQ ID NO: 1820 - DNA, 16 bp, synthetic construct
  source 1..16: mol_type = other DNA
tgattcgaaactattc

SEQ ID NO: 1821 - DNA, 16 bp, synthetic construct
  source 1..16: mol_type = other DNA
actgctgctagtgcca

SEQ ID NO: 1822 - DNA, 16 bp, synthetic construct
  source 1..16: mol_type = other DNA
agcttttgtccacctt

SEQ ID NO: 1823 - DNA, 16 bp, synthetic construct
  source 1..16: mol_type = other DNA
cttaaaccttccctgt

SEQ ID NO: 1824 - DNA, 16 bp, synthetic construct
  source 1..16: mol_type = other DNA
ctacagattggaatgc

SEQ ID NO: 1825 - DNA, 16 bp, synthetic construct
  source 1..16: mol_type = other DNA
ctgtgcactcattctg

SEQ ID NO: 1826 - DNA, 16 bp, synthetic construct
  source 1..16: mol_type = other DNA
ggttgagataaagctg

SEQ ID NO: 1827 - DNA, 16 bp, synthetic construct
  source 1..16: mol_type = other DNA
gttgcaccgttttggg

SEQ ID NO: 1828 - DNA, 16 bp, synthetic construct
  source 1..16: mol_type = other DNA
tttggtggacttcaga

SEQ ID NO: 1829 - DNA, 16 bp, synthetic construct
  source 1..16: mol_type = other DNA
cacctttcataatgta

SEQ ID NO: 1830 - DNA, 16 bp, synthetic construct
  source 1..16: mol_type = other DNA
tctgggaccaaggata

SEQ ID NO: 1831 - DNA, 16 bp, synthetic construct
  source 1..16: mol_type = other DNA
gccagtacagttcctt

SEQ ID NO: 1832 - DNA, 16 bp, synthetic construct
  source 1..16: mol_type = other DNA
gtcggattattttttc

SEQ ID NO: 1833 - DNA, 16 bp, synthetic construct
  source 1..16: mol_type = other DNA
acaagattagtcttga

SEQ ID NO: 1834 - DNA, 16 bp, synthetic construct
  source 1..16: mol_type = other DNA
gatgtatacattacct

SEQ ID NO: 1835 - DNA, 16 bp, synthetic construct
  source 1..16: mol_type = other DNA
ataaaaatcgctgctt

SEQ ID NO: 1836 - DNA, 16 bp, synthetic construct
  source 1..16: mol_type = other DNA
atcatatgctaagtgc

SEQ ID NO: 1837 - DNA, 16 bp, synthetic construct
  source 1..16: mol_type = other DNA
cagaaagttcattcga

SEQ ID NO: 1838 - DNA, 16 bp, synthetic construct
  source 1..16: mol_type = other DNA
tacattacagccttag

SEQ ID NO: 1839 - DNA, 16 bp, synthetic construct
  source 1..16: mol_type = other DNA
gttttttgaaccgtat

SEQ ID NO: 1840 - DNA, 16 bp, synthetic construct
  source 1..16: mol_type = other DNA
agaataggagagtctt

SEQ ID NO: 1841 - DNA, 16 bp, synthetic construct
  source 1..16: mol_type = other DNA
gtattgagatgacagt

SEQ ID NO: 1842 - DNA, 16 bp, synthetic construct
  source 1..16: mol_type = other DNA
cccataaccataggac

SEQ ID NO: 1843 - DNA, 16 bp, synthetic construct
  source 1..16: mol_type = other DNA
gcagtaaagtgctaag

SEQ ID NO: 1844 - DNA, 16 bp, synthetic construct
  source 1..16: mol_type = other DNA
gaagattagttaacct

SEQ ID NO: 1845 - DNA, 16 bp, synthetic construct
  source 1..16: mol_type = other DNA
catattccctgatgat

SEQ ID NO: 1846 - DNA, 16 bp, synthetic construct
  source 1..16: mol_type = other DNA
aactacatgacctggg

SEQ ID NO: 1847 - DNA, 16 bp, synthetic construct
  source 1..16: mol_type = other DNA
ttctattgtatgaggt

SEQ ID NO: 1848 - DNA, 16 bp, synthetic construct
  source 1..16: mol_type = other DNA
gtccagaagtatgtga

SEQ ID NO: 1849 - DNA, 16 bp, synthetic construct
  source 1..16: mol_type = other DNA
tcctatatacatccaa

SEQ ID NO: 1850 - DNA, 16 bp, synthetic construct
  source 1..16: mol_type = other DNA
cactaatattgaggca

SEQ ID NO: 1851 - DNA, 16 bp, synthetic construct
  source 1..16: mol_type = other DNA
cagctataggtagcta

SEQ ID NO: 1852 - DNA, 16 bp, synthetic construct
  source 1..16: mol_type = other DNA
tagtgtaagctgagag

SEQ ID NO: 1853 - DNA, 16 bp, synthetic construct
  source 1..16: mol_type = other DNA
gtatggtaagccccat

SEQ ID NO: 1854 - DNA, 16 bp, synthetic construct
  source 1..16: mol_type = other DNA
tatataacatggctgg

SEQ ID NO: 1855 - DNA, 16 bp, synthetic construct
  source 1..16: mol_type = other DNA
tgacatagacatgtgt

SEQ ID NO: 1856 - DNA, 16 bp, synthetic construct
  source 1..16: mol_type = other DNA
ctgtaggactctgctc

SEQ ID NO: 1857 - DNA, 16 bp, synthetic construct
  source 1..16: mol_type = other DNA
tgagaaggcggtatca

SEQ ID NO: 1858 - DNA, 16 bp, synthetic construct
  source 1..16: mol_type = other DNA
ccctaatgtgttttcc

SEQ ID NO: 1859 - DNA, 16 bp, synthetic construct
  source 1..16: mol_type = other DNA
cttaattttcgggttc

SEQ ID NO: 1860 - DNA, 16 bp, synthetic construct
  source 1..16: mol_type = other DNA
taggattaattccctt

SEQ ID NO: 1861 - DNA, 16 bp, synthetic construct
  source 1..16: mol_type = other DNA
aatacaggatagagca

SEQ ID NO: 1862 - DNA, 16 bp, synthetic construct
  source 1..16: mol_type = other DNA
taggaaagctcatggt

SEQ ID NO: 1863 - DNA, 16 bp, synthetic construct
  source 1..16: mol_type = other DNA
ggaaattcacaatcta

SEQ ID NO: 1864 - DNA, 16 bp, synthetic construct
  source 1..16: mol_type = other DNA
ttgaatagcaagccaa

SEQ ID NO: 1865 - DNA, 16 bp, synthetic construct
  source 1..16: mol_type = other DNA
taaacataggcttagt

SEQ ID NO: 1866 - DNA, 16 bp, synthetic construct
  source 1..16: mol_type = other DNA
taaatacccttggtgg

SEQ ID NO: 1867 - DNA, 16 bp, synthetic construct
  source 1..16: mol_type = other DNA
ttaatcatgggacagg

SEQ ID NO: 1868 - DNA, 16 bp, synthetic construct
  source 1..16: mol_type = other DNA
tcaaaatggtggcgag

SEQ ID NO: 1869 - DNA, 16 bp, synthetic construct
  source 1..16: mol_type = other DNA
agtatttgggtgttct

SEQ ID NO: 1870 - DNA, 16 bp, synthetic construct
  source 1..16: mol_type = other DNA
tcactatattgcattc

SEQ ID NO: 1871 - DNA, 16 bp, synthetic construct
  source 1..16: mol_type = other DNA
agggaatgttatgtac

SEQ ID NO: 1872 - DNA, 16 bp, synthetic construct
  source 1..16: mol_type = other DNA
aaaaggcccaaggctt

SEQ ID NO: 1873 - DNA, 16 bp, synthetic construct
  source 1..16: mol_type = other DNA
gtaattgcatctgctc

SEQ ID NO: 1874 - DNA, 16 bp, synthetic construct
  source 1..16: mol_type = other DNA
atgcataagagatgag

SEQ ID NO: 1875 - DNA, 16 bp, synthetic construct
  source 1..16: mol_type = other DNA
ctatgcaagccttcac

SEQ ID NO: 1876 - DNA, 16 bp, synthetic construct
  source 1..16: mol_type = other DNA
gtaatattcatagttc

SEQ ID NO: 1877 - DNA, 16 bp, synthetic construct
  source 1..16: mol_type = other DNA
ccaattatgaatctgc

SEQ ID NO: 1878 - DNA, 16 bp, synthetic construct
  source 1..16: mol_type = other DNA
tagtaattgctatagt

SEQ ID NO: 1879 - DNA, 16 bp, synthetic construct
  source 1..16: mol_type = other DNA
tcatttagaatacgct

SEQ ID NO: 1880 - DNA, 16 bp, synthetic construct
  source 1..16: mol_type = other DNA
ccttctggttcagtcc

SEQ ID NO: 1881 - DNA, 16 bp, synthetic construct
  source 1..16: mol_type = other DNA
tccaagtaggagtaga

SEQ ID NO: 1882 - DNA, 16 bp, synthetic construct
  source 1..16: mol_type = other DNA
agtaatgagaacaatc

SEQ ID NO: 1883 - DNA, 16 bp, synthetic construct
  source 1..16: mol_type = other DNA
cccacagaaccaatat

SEQ ID NO: 1884 - DNA, 16 bp, synthetic construct
  source 1..16: mol_type = other DNA
gttttcggcactcagc

SEQ ID NO: 1885 - DNA, 16 bp, synthetic construct
  source 1..16: mol_type = other DNA
agcgatagatctcttc

SEQ ID NO: 1886 - DNA, 16 bp, synthetic construct
  source 1..16: mol_type = other DNA
acgattgttacatcac

SEQ ID NO: 1887 - DNA, 16 bp, synthetic construct
  source 1..16: mol_type = other DNA
gctggatatactgtcc

SEQ ID NO: 1888 - DNA, 16 bp, synthetic construct
  source 1..16: mol_type = other DNA
atgtcttggtaatctc

SEQ ID NO: 1889 - DNA, 16 bp, synthetic construct
  source 1..16: mol_type = other DNA
gtgcttttgtgatcca

SEQ ID NO: 1890 - DNA, 16 bp, synthetic construct
  source 1..16: mol_type = other DNA
actgtgacgatgtggc

SEQ ID NO: 1891 - DNA, 16 bp, synthetic construct
  source 1..16: mol_type = other DNA
tggaacaatatgggat

SEQ ID NO: 1892 - DNA, 16 bp, synthetic construct
  source 1..16: mol_type = other DNA
aaggcctgaagttctg

SEQ ID NO: 1893 - DNA, 16 bp, synthetic construct
  source 1..16: mol_type = other DNA
aggccataatcttgtg

SEQ ID NO: 1894 - DNA, 16 bp, synthetic construct
  source 1..16: mol_type = other DNA
cagacttcttacgact

SEQ ID NO: 1895 - DNA, 16 bp, synthetic construct
  source 1..16: mol_type = other DNA
tgatatacgatggaac

SEQ ID NO: 1896 - DNA, 16 bp, synthetic construct
  source 1..16: mol_type = other DNA
ctgcatacgatttaaa

SEQ ID NO: 1897 - DNA, 16 bp, synthetic construct
  source 1..16: mol_type = other DNA
tggctggagcttattt

SEQ ID NO: 1898 - DNA, 16 bp, synthetic construct
  source 1..16: mol_type = other DNA
ttgattcgaaactatt

SEQ ID NO: 1899 - DNA, 16 bp, synthetic construct
  source 1..16: mol_type = other DNA
gactgctgctagtgcc

SEQ ID NO: 1900 - DNA, 16 bp, synthetic construct
  source 1..16: mol_type = other DNA
tagcttttgtccacct

SEQ ID NO: 1901 - DNA, 16 bp, synthetic construct
  source 1..16: mol_type = other DNA
gtcttaaaccttccct

SEQ ID NO: 1902 - DNA, 16 bp, synthetic construct
  source 1..16: mol_type = other DNA
gctacagattggaatg

SEQ ID NO: 1903 - DNA, 16 bp, synthetic construct
  source 1..16: mol_type = other DNA
agctgtgcactcattc

SEQ ID NO: 1904 - DNA, 16 bp, synthetic construct
  source 1..16: mol_type = other DNA
aggttgagataaagct

SEQ ID NO: 1905 - DNA, 16 bp, synthetic construct
  source 1..16: mol_type = other DNA
agttgcaccgttttgg

SEQ ID NO: 1906 - DNA, 16 bp, synthetic construct
  source 1..16: mol_type = other DNA
cttttggtggacttca

SEQ ID NO: 1907 - DNA, 16 bp, synthetic construct
  source 1..16: mol_type = other DNA
gtcacctttcataatg

SEQ ID NO: 1908 - DNA, 16 bp, synthetic construct
  source 1..16: mol_type = other DNA
ctctgggaccaaggat

SEQ ID NO: 1909 - DNA, 16 bp, synthetic construct
  source 1..16: mol_type = other DNA
agccagtacagttcct

SEQ ID NO: 1910 - DNA, 16 bp, synthetic construct
  source 1..16: mol_type = other DNA
agtcggattatttttt

SEQ ID NO: 1911 - DNA, 16 bp, synthetic construct
  source 1..16: mol_type = other DNA
aacaagattagtcttg

SEQ ID NO: 1912 - DNA, 16 bp, synthetic construct
  source 1..16: mol_type = other DNA
catatcttactctgtg

SEQ ID NO: 1913 - DNA, 16 bp, synthetic construct
  source 1..16: mol_type = other DNA
cataaaaatcgctgct

SEQ ID NO: 1914 - DNA, 16 bp, synthetic construct
  source 1..16: mol_type = other DNA
cgtttatcatatgcta

SEQ ID NO: 1915 - DNA, 16 bp, synthetic construct
  source 1..16: mol_type = other DNA
ccagaaagttcattcg

SEQ ID NO: 1916 - DNA, 16 bp, synthetic construct
  source 1..16: mol_type = other DNA
ttacattacagcctta

SEQ ID NO: 1917 - DNA, 16 bp, synthetic construct
  source 1..16: mol_type = other DNA
ttaaactccaatgtgt

SEQ ID NO: 1918 - DNA, 16 bp, synthetic construct
  source 1..16: mol_type = other DNA
ctcaaatagccttttg

SEQ ID NO: 1919 - DNA, 16 bp, synthetic construct
  source 1..16: mol_type = other DNA
cctgaaaagccctatt

SEQ ID NO: 1920 - DNA, 16 bp, synthetic construct
  source 1..16: mol_type = other DNA
accaaacttgcccata

SEQ ID NO: 1921 - DNA, 16 bp, synthetic construct
  source 1..16: mol_type = other DNA
ggcagtaaagtgctaa

SEQ ID NO: 1922 - DNA, 16 bp, synthetic construct
  source 1..16: mol_type = other DNA
tgaagattagttaacc

SEQ ID NO: 1923 - DNA, 16 bp, synthetic construct
  source 1..16: mol_type = other DNA
atccatattccctgat

SEQ ID NO: 1924 - DNA, 16 bp, synthetic construct
  source 1..16: mol_type = other DNA
taactacatgacctgg

SEQ ID NO: 1925 - DNA, 16 bp, synthetic construct
  source 1..16: mol_type = other DNA
gatgagagtctttctt

SEQ ID NO: 1926 - DNA, 16 bp, synthetic construct
  source 1..16: mol_type = other DNA
aaagatctggccagtt

SEQ ID NO: 1927 - DNA, 16 bp, synthetic construct
  source 1..16: mol_type = other DNA
atcctatatacatcca

SEQ ID NO: 1928 - DNA, 16 bp, synthetic construct
  source 1..16: mol_type = other DNA
acactaatattgaggc

SEQ ID NO: 1929 - DNA, 16 bp, synthetic construct
  source 1..16: mol_type = other DNA
gaacatacattgttgc

SEQ ID NO: 1930 - DNA, 16 bp, synthetic construct
  source 1..16: mol_type = other DNA
gttgagtagtgtaagc

SEQ ID NO: 1931 - DNA, 16 bp, synthetic construct
  source 1..16: mol_type = other DNA
ttattggtatggtaag

SEQ ID NO: 1932 - DNA, 16 bp, synthetic construct
  source 1..16: mol_type = other DNA
gtaattggctcttgag

SEQ ID NO: 1933 - DNA, 16 bp, synthetic construct
  source 1..16: mol_type = other DNA
atgacatagacatgtg

SEQ ID NO: 1934 - DNA, 16 bp, synthetic construct
  source 1..16: mol_type = other DNA
ctacaaaactggtatc

SEQ ID NO: 1935 - DNA, 16 bp, synthetic construct
  source 1..16: mol_type = other DNA
accaatcctcagcttt

SEQ ID NO: 1936 - DNA, 16 bp, synthetic construct
  source 1..16: mol_type = other DNA
gatcattcctgctagt

SEQ ID NO: 1937 - DNA, 16 bp, synthetic construct
  source 1..16: mol_type = other DNA
gcttaattttcgggtt

SEQ ID NO: 1938 - DNA, 16 bp, synthetic construct
  source 1..16: mol_type = other DNA
ttaggattaattccct

SEQ ID NO: 1939 - DNA, 16 bp, synthetic construct
  source 1..16: mol_type = other DNA
acaatacaggatagag

SEQ ID NO: 1940 - DNA, 16 bp, synthetic construct
  source 1..16: mol_type = other DNA
ttaggaaagctcatgg

SEQ ID NO: 1941 - DNA, 16 bp, synthetic construct
  source 1..16: mol_type = other DNA
cttactaaggaaattc

SEQ ID NO: 1942 - DNA, 16 bp, synthetic construct
  source 1..16: mol_type = other DNA
ccttgaatagcaagcc

SEQ ID NO: 1943 - DNA, 16 bp, synthetic construct
  source 1..16: mol_type = other DNA
ataaacataggcttag

SEQ ID NO: 1944 - DNA, 16 bp, synthetic construct
  source 1..16: mol_type = other DNA
tctaaatacccttggt

SEQ ID NO: 1945 - DNA, 16 bp, synthetic construct
  source 1..16: mol_type = other DNA
attaatcatgggacag

SEQ ID NO: 1946 - DNA, 16 bp, synthetic construct
  source 1..16: mol_type = other DNA
atcaaaatggtggcga

SEQ ID NO: 1947 - DNA, 16 bp, synthetic construct
  source 1..16: mol_type = other DNA
tagtatttgggtgttc

SEQ ID NO: 1948 - DNA, 16 bp, synthetic construct
  source 1..16: mol_type = other DNA
accaaacttccagcag

SEQ ID NO: 1949 - DNA, 16 bp, synthetic construct
  source 1..16: mol_type = other DNA
caaaacctttgttgcc

SEQ ID NO: 1950 - DNA, 16 bp, synthetic construct
  source 1..16: mol_type = other DNA
tcaaaaaggcccaagg

SEQ ID NO: 1951 - DNA, 16 bp, synthetic construct
  source 1..16: mol_type = other DNA
agtaattgcatctgct

SEQ ID NO: 1952 - DNA, 16 bp, synthetic construct
  source 1..16: mol_type = other DNA
caggaatgcataagag

SEQ ID NO: 1953 - DNA, 16 bp, synthetic construct
  source 1..16: mol_type = other DNA
accagaatccattcta

SEQ ID NO: 1954 - DNA, 16 bp, synthetic construct
  source 1..16: mol_type = other DNA
aatcaatctgtctgaa

SEQ ID NO: 1955 - DNA, 16 bp, synthetic construct
  source 1..16: mol_type = other DNA
cccaattatgaatctg

SEQ ID NO: 1956 - DNA, 16 bp, synthetic construct
  source 1..16: mol_type = other DNA
atagtaattgctatag

SEQ ID NO: 1957 - DNA, 16 bp, synthetic construct
  source 1..16: mol_type = other DNA
gtcatttagaatacgc

SEQ ID NO: 1958 - DNA, 16 bp, synthetic construct
  source 1..16: mol_type = other DNA
atgttcatggctttgc

SEQ ID NO: 1959 - DNA, 16 bp, synthetic construct
  source 1..16: mol_type = other DNA
ctccaagtaggagtag

SEQ ID NO: 1960 - DNA, 16 bp, synthetic construct
  source 1..16: mol_type = other DNA
ctccagtaatgagaac

SEQ ID NO: 1961 - DNA, 16 bp, synthetic construct
  source 1..16: mol_type = other DNA
tcccacagaaccaata

SEQ ID NO: 1962 - DNA, 16 bp, synthetic construct
  source 1..16: mol_type = other DNA
agttttcggcactcag

SEQ ID NO: 1963 - DNA, 16 bp, synthetic construct
  source 1..16: mol_type = other DNA
gagcgatagatctctt

SEQ ID NO: 1964 - DNA, 16 bp, synthetic construct
  source 1..16: mol_type = other DNA
cacgattgttacatca

SEQ ID NO: 1965 - DNA, 16 bp, synthetic construct
  source 1..16: mol_type = other DNA
ggctggatatactgtc

SEQ ID NO: 1966 - DNA, 16 bp, synthetic construct
  source 1..16: mol_type = other DNA
aatgtcttggtaatct

SEQ ID NO: 1967 - DNA, 16 bp, synthetic construct
  source 1..16: mol_type = other DNA
agtgcttttgtgatcc

SEQ ID NO: 1968 - DNA, 16 bp, synthetic construct
  source 1..16: mol_type = other DNA
cactgtgacgatgtgg

SEQ ID NO: 1969 - DNA, 16 bp, synthetic construct
  source 1..16: mol_type = other DNA
ctggaacaatatggga

SEQ ID NO: 1970 - DNA, 16 bp, synthetic construct
  source 1..16: mol_type = other DNA
ccaaggcctgaagttc

SEQ ID NO: 1971 - DNA, 16 bp, synthetic construct
  source 1..16: mol_type = other DNA
tacaggccataatctt

SEQ ID NO: 1972 - DNA, 16 bp, synthetic construct
  source 1..16: mol_type = other DNA
tcagacttcttacgac

SEQ ID NO: 1973 - DNA, 16 bp, synthetic construct
  source 1..16: mol_type = other DNA
ttgatatacgatggaa

SEQ ID NO: 1974 - DNA, 16 bp, synthetic construct
  source 1..16: mol_type = other DNA
tctgcatacgatttaa

SEQ ID NO: 1975 - DNA, 16 bp, synthetic construct
  source 1..16: mol_type = other DNA
ctggctggagcttatt

SEQ ID NO: 1976 - DNA, 16 bp, synthetic construct
  source 1..16: mol_type = other DNA
attgattcgaaactat

SEQ ID NO: 1977 - DNA, 16 bp, synthetic construct
  source 1..16: mol_type = other DNA
tgactgctgctagtgc

SEQ ID NO: 1978 - DNA, 16 bp, synthetic construct
  source 1..16: mol_type = other DNA
gtagcttttgtccacc

SEQ ID NO: 1979 - DNA, 16 bp, synthetic construct
  source 1..16: mol_type = other DNA
agtcttaaaccttccc

SEQ ID NO: 1980 - DNA, 16 bp, synthetic construct
  source 1..16: mol_type = other DNA
ggctacagattggaat

SEQ ID NO: 1981 - DNA, 16 bp, synthetic construct
  source 1..16: mol_type = other DNA
tagctgtgcactcatt

SEQ ID NO: 1982 - DNA, 16 bp, synthetic construct
  source 1..16: mol_type = other DNA
caggttgagataaagc

SEQ ID NO: 1983 - DNA, 16 bp, synthetic construct
  source 1..16: mol_type = other DNA
gagttgcaccgttttg

SEQ ID NO: 1984 - DNA, 16 bp, synthetic construct
  source 1..16: mol_type = other DNA
acttttggtggacttc

SEQ ID NO: 1985 - DNA, 16 bp, synthetic construct
  source 1..16: mol_type = other DNA
ggtcacctttcataat

SEQ ID NO: 1986 - DNA, 16 bp, synthetic construct
  source 1..16: mol_type = other DNA
tctctgggaccaagga

SEQ ID NO: 1987 - DNA, 16 bp, synthetic construct
  source 1..16: mol_type = other DNA
tagccagtacagttcc

SEQ ID NO: 1988 - DNA, 16 bp, synthetic construct
  source 1..16: mol_type = other DNA
gagtcggattattttt

SEQ ID NO: 1989 - DNA, 16 bp, synthetic construct
  source 1..16: mol_type = other DNA
caaaacaagattagtc

SEQ ID NO: 1990 - DNA, 16 bp, synthetic construct
  source 1..16: mol_type = other DNA
tacatatcttactctg

SEQ ID NO: 1991 - DNA, 16 bp, synthetic construct
  source 1..16: mol_type = other DNA
tcataaaaatcgctgc

SEQ ID NO: 1992 - DNA, 16 bp, synthetic construct
  source 1..16: mol_type = other DNA
gtttatcatgtgccac

SEQ ID NO: 1993 - DNA, 16 bp, synthetic construct
  source 1..16: mol_type = other DNA
gtaaattcttgctatc

SEQ ID NO: 1994 - DNA, 16 bp, synthetic construct
  source 1..16: mol_type = other DNA
gttacattacagcctt

SEQ ID NO: 1995 - DNA, 16 bp, synthetic construct
  source 1..16: mol_type = other DNA
agcttaaactccaatg

SEQ ID NO: 1996 - DNA, 16 bp, synthetic construct
  source 1..16: mol_type = other DNA
tcaaagtcagtatccc

SEQ ID NO: 1997 - DNA, 16 bp, synthetic construct
  source 1..16: mol_type = other DNA
gatacctgaaaagccc

SEQ ID NO: 1998 - DNA, 16 bp, synthetic construct
  source 1..16: mol_type = other DNA
taccaaacttgcccat

SEQ ID NO: 1999 - DNA, 16 bp, synthetic construct
  source 1..16: mol_type = other DNA
atgtaataggcagtaa

SEQ ID NO: 2000 - DNA, 16 bp, synthetic construct
  source 1..16: mol_type = other DNA
acaattaacattcggc

SEQ ID NO: 2001 - DNA, 16 bp, synthetic construct
  source 1..16: mol_type = other DNA
taggaagtgatccata

SEQ ID NO: 2002 - DNA, 16 bp, synthetic construct
  source 1..16: mol_type = other DNA
ataactacatgacctg

SEQ ID NO: 2003 - DNA, 16 bp, synthetic construct
  source 1..16: mol_type = other DNA
ccaaagatgagagtct

SEQ ID NO: 2004 - DNA, 16 bp, synthetic construct
  source 1..16: mol_type = other DNA
caaagatctggccagt

SEQ ID NO: 2005 - DNA, 16 bp, synthetic construct
  source 1..16: mol_type = other DNA
caaaagtgtcctcgat

SEQ ID NO: 2006 - DNA, 16 bp, synthetic construct
  source 1..16: mol_type = other DNA
tacactaatattgagg

SEQ ID NO: 2007 - DNA, 16 bp, synthetic construct
  source 1..16: mol_type = other DNA
tgaacatacattgttg

SEQ ID NO: 2008 - DNA, 16 bp, synthetic construct
  source 1..16: mol_type = other DNA
gacagttgagtagtgt

SEQ ID NO: 2009 - DNA, 16 bp, synthetic construct
  source 1..16: mol_type = other DNA
tttattggtatggtaa

SEQ ID NO: 2010 - DNA, 16 bp, synthetic construct
  source 1..16: mol_type = other DNA
tgtaattggctcttga

SEQ ID NO: 2011 - DNA, 16 bp, synthetic construct
  source 1..16: mol_type = other DNA
accaaggccatgacat

SEQ ID NO: 2012 - DNA, 16 bp, synthetic construct
  source 1..16: mol_type = other DNA
tctacaaaactggtat

SEQ ID NO: 2013 - DNA, 16 bp, synthetic construct
  source 1..16: mol_type = other DNA
aaccaatcctcagctt

SEQ ID NO: 2014 - DNA, 16 bp, synthetic construct
  source 1..16: mol_type = other DNA
gatcaaatgtatgtgc

SEQ ID NO: 2015 - DNA, 16 bp, synthetic construct
  source 1..16: mol_type = other DNA
ggcttaattttcgggt

SEQ ID NO: 2016 - DNA, 16 bp, synthetic construct
  source 1..16: mol_type = other DNA
tttaggattaattccc

SEQ ID NO: 2017 - DNA, 16 bp, synthetic construct
  source 1..16: mol_type = other DNA
gacaatacaggataga

SEQ ID NO: 2018 - DNA, 16 bp, synthetic construct
  source 1..16: mol_type = other DNA
cttaggaaagctcatg

SEQ ID NO: 2019 - DNA, 16 bp, synthetic construct
  source 1..16: mol_type = other DNA
ccttactaaggaaatt

SEQ ID NO: 2020 - DNA, 16 bp, synthetic construct
  source 1..16: mol_type = other DNA
tgtgattgagttctcc

SEQ ID NO: 2021 - DNA, 16 bp, synthetic construct
  source 1..16: mol_type = other DNA
tcataaacataggctt

SEQ ID NO: 2022 - DNA, 16 bp, synthetic construct
  source 1..16: mol_type = other DNA
ctctaaatacccttgg

SEQ ID NO: 2023 - DNA, 16 bp, synthetic construct
  source 1..16: mol_type = other DNA
gattaatcatgggaca

SEQ ID NO: 2024 - DNA, 16 bp, synthetic construct
  source 1..16: mol_type = other DNA
tatcaaaatggtggcg

SEQ ID NO: 2025 - DNA, 16 bp, synthetic construct
  source 1..16: mol_type = other DNA
ttagtatttgggtgtt

SEQ ID NO: 2026 - DNA, 16 bp, synthetic construct
  source 1..16: mol_type = other DNA
tcccaaccaaacttcc

SEQ ID NO: 2027 - DNA, 16 bp, synthetic construct
  source 1..16: mol_type = other DNA
gcatattcatttggcc

SEQ ID NO: 2028 - DNA, 16 bp, synthetic construct
  source 1..16: mol_type = other DNA
gtttcaaaaaggccca

SEQ ID NO: 2029 - DNA, 16 bp, synthetic construct
  source 1..16: mol_type = other DNA
tagtaattgcatctgc

SEQ ID NO: 2030 - DNA, 16 bp, synthetic construct
  source 1..16: mol_type = other DNA
tggaggaaagcttcaa

SEQ ID NO: 2031 - DNA, 16 bp, synthetic construct
  source 1..16: mol_type = other DNA
accaagagacaccacc

SEQ ID NO: 2032 - DNA, 16 bp, synthetic construct
  source 1..16: mol_type = other DNA
cttacgacaggtcatc

SEQ ID NO: 2033 - DNA, 16 bp, synthetic construct
  source 1..16: mol_type = other DNA
ttagaagtcagcccaa

SEQ ID NO: 2034 - DNA, 16 bp, synthetic construct
  source 1..16: mol_type = other DNA
ctatagtaattgctat

SEQ ID NO: 2035 - DNA, 16 bp, synthetic construct
  source 1..16: mol_type = other DNA
ggtcatttagaatacg

SEQ ID NO: 2036 - DNA, 16 bp, synthetic construct
  source 1..16: mol_type = other DNA
cagttattagaagtca

SEQ ID NO: 2037 - DNA, 16 bp, synthetic construct
  source 1..16: mol_type = other DNA
gagttatctggtttgc

SEQ ID NO: 2038 - DNA, 16 bp, synthetic construct
  source 1..16: mol_type = other DNA
tcgatcctatatacat

SEQ ID NO: 2039 - DNA, 16 bp, synthetic construct
  source 1..16: mol_type = other DNA
gctgaaactgctgatt

SEQ ID NO: 2040 - DNA, 16 bp, synthetic construct
  source 1..16: mol_type = other DNA
acagttccttttcctg

SEQ ID NO: 2041 - DNA, 16 bp, synthetic construct
  source 1..16: mol_type = other DNA
tacttaccaatatggg

SEQ ID NO: 2042 - DNA, 16 bp, synthetic construct
  source 1..16: mol_type = other DNA
taactgagttattctc

SEQ ID NO: 2043 - DNA, 16 bp, synthetic construct
  source 1..16: mol_type = other DNA
ctaaactagtggtaat

SEQ ID NO: 2044 - DNA, 16 bp, synthetic construct
  source 1..16: mol_type = other DNA
taggtagctaatgtat

SEQ ID NO: 2045 - DNA, 16 bp, synthetic construct
  source 1..16: mol_type = other DNA
taattacaacctggtt

SEQ ID NO: 2046 - DNA, 16 bp, synthetic construct
  source 1..16: mol_type = other DNA
gtaaaggctgggtgag

SEQ ID NO: 2047 - DNA, 16 bp, synthetic construct
  source 1..16: mol_type = other DNA
tcataccacataccca

SEQ ID NO: 2048 - DNA, 16 bp, synthetic construct
  source 1..16: mol_type = other DNA
cttagtaccaagacac

SEQ ID NO: 2049 - DNA, 16 bp, synthetic construct
  source 1..16: mol_type = other DNA
gatgctccataataat

SEQ ID NO: 2050 - DNA, 16 bp, synthetic construct
  source 1..16: mol_type = other DNA
tgcatcttaagatacc

SEQ ID NO: 2051 - DNA, 16 bp, synthetic construct
  source 1..16: mol_type = other DNA
agaatagtcttcagca

SEQ ID NO: 2052 - DNA, 16 bp, synthetic construct
  source 1..16: mol_type = other DNA
ggctaaaatggtcatc

SEQ ID NO: 2053 - DNA, 16 bp, synthetic construct
  source 1..16: mol_type = other DNA
taagagatgagtaggc

SEQ ID NO: 2054 - DNA, 16 bp, synthetic construct
  source 1..16: mol_type = other DNA
tctatagctaagtata

SEQ ID NO: 2055 - DNA, 16 bp, synthetic construct
  source 1..16: mol_type = other DNA
tattcttatgtcatcc

SEQ ID NO: 2056 - DNA, 16 bp, synthetic construct
  source 1..16: mol_type = other DNA
attggtaagtattcca

SEQ ID NO: 2057 - DNA, 16 bp, synthetic construct
  source 1..16: mol_type = other DNA
tttaagaggcatgaaa

SEQ ID NO: 2058 - DNA, 16 bp, synthetic construct
  source 1..16: mol_type = other DNA
tcaagacattctagcc

SEQ ID NO: 2059 - DNA, 16 bp, synthetic construct
  source 1..16: mol_type = other DNA
ctagatactcaattta

SEQ ID NO: 2060 - DNA, 16 bp, synthetic construct
  source 1..16: mol_type = other DNA
ggctgtaagagtcagt

SEQ ID NO: 2061 - DNA, 16 bp, synthetic construct
  source 1..16: mol_type = other DNA
cctaccaagagggttt

SEQ ID NO: 2062 - DNA, 16 bp, synthetic construct
  source 1..16: mol_type = other DNA
attgttagctaaggga

SEQ ID NO: 2063 - DNA, 16 bp, synthetic construct
  source 1..16: mol_type = other DNA
gccttgaatagcaagc

SEQ ID NO: 2064 - DNA, 16 bp, synthetic construct
  source 1..16: mol_type = other DNA
acaggatagagcacat

SEQ ID NO: 2065 - DNA, 16 bp, synthetic construct
  source 1..16: mol_type = other DNA
acattagcaagctaag

SEQ ID NO: 2066 - DNA, 16 bp, synthetic construct
  source 1..16: mol_type = other DNA
atccagatctgcccta

SEQ ID NO: 2067 - DNA, 16 bp, synthetic construct
  source 1..16: mol_type = other DNA
ttgcaagtttatcagt

SEQ ID NO: 2068 - DNA, 16 bp, synthetic construct
  source 1..16: mol_type = other DNA
gtttcaactaaacatg

SEQ ID NO: 2069 - DNA, 16 bp, synthetic construct
  source 1..16: mol_type = other DNA
ggaccagggaatttat

SEQ ID NO: 2070 - DNA, 16 bp, synthetic construct
  source 1..16: mol_type = other DNA
cttttgtccaccttta

SEQ ID NO: 2071 - DNA, 16 bp, synthetic construct
  source 1..16: mol_type = other DNA
gtcagtagagagcata

SEQ ID NO: 2072 - DNA, 16 bp, synthetic construct
  source 1..16: mol_type = other DNA
tttcacctcaggtgac

SEQ ID NO: 2073 - DNA, 16 bp, synthetic construct
  source 1..16: mol_type = other DNA
ctcgcctaaaggagat

SEQ ID NO: 2074 - DNA, 16 bp, synthetic construct
  source 1..16: mol_type = other DNA
tcctttgtatttcgct

SEQ ID NO: 2075 - DNA, 16 bp, synthetic construct
  source 1..16: mol_type = other DNA
cctccttatttgttag

SEQ ID NO: 2076 - DNA, 16 bp, synthetic construct
  source 1..16: mol_type = other DNA
tttcagatcccgttct

SEQ ID NO: 2077 - DNA, 16 bp, synthetic construct
  source 1..16: mol_type = other DNA
agtgtaagctgagagt

SEQ ID NO: 2078 - DNA, 16 bp, synthetic construct
  source 1..16: mol_type = other DNA
ccaacgcaacagttta

SEQ ID NO: 2079 - DNA, 16 bp, synthetic construct
  source 1..16: mol_type = other DNA
agcattcatcagatgt

SEQ ID NO: 2080 - DNA, 16 bp, synthetic construct
  source 1..16: mol_type = other DNA
ttgcaaaatgtgatgc

SEQ ID NO: 2081 - DNA, 16 bp, synthetic construct
  source 1..16: mol_type = other DNA
gtgtttacaagtaaga

SEQ ID NO: 2082 - DNA, 16 bp, synthetic construct
  source 1..16: mol_type = other DNA
agatgggcaaggccac

SEQ ID NO: 2083 - DNA, 16 bp, synthetic construct
  source 1..16: mol_type = other DNA
ctggagaagagtttac

SEQ ID NO: 2084 - DNA, 16 bp, synthetic construct
  source 1..16: mol_type = other DNA
agacagactgttgagc

SEQ ID NO: 2085 - DNA, 16 bp, synthetic construct
  source 1..16: mol_type = other DNA
catagtttatatggat

SEQ ID NO: 2086 - DNA, 16 bp, synthetic construct
  source 1..16: mol_type = other DNA
tgttatctcaagtcag

SEQ ID NO: 2087 - DNA, 16 bp, synthetic construct
  source 1..16: mol_type = other DNA
atgttaggacccagtc

SEQ ID NO: 2088 - DNA, 16 bp, synthetic construct
  source 1..16: mol_type = other DNA
tacactgacaaccctt

SEQ ID NO: 2089 - DNA, 16 bp, synthetic construct
  source 1..16: mol_type = other DNA
gagaaatctaagaacc

SEQ ID NO: 2090 - DNA, 16 bp, synthetic construct
  source 1..16: mol_type = other DNA
aatgaatcatgattga

SEQ ID NO: 2091 - DNA, 16 bp, synthetic construct
  source 1..16: mol_type = other DNA
tgaaatcttgtgtaac

SEQ ID NO: 2092 - DNA, 16 bp, synthetic construct
  source 1..16: mol_type = other DNA
agtgcttagttcattg

SEQ ID NO: 2093 - DNA, 16 bp, synthetic construct
  source 1..16: mol_type = other DNA
caatcccaaccaaact

SEQ ID NO: 2094 - DNA, 16 bp, synthetic construct
  source 1..16: mol_type = other DNA
cttggaaggagactgg

SEQ ID NO: 2095 - DNA, 16 bp, synthetic construct
  source 1..16: mol_type = other DNA
ccgcccttaagtcatt

SEQ ID NO: 2096 - DNA, 16 bp, synthetic construct
  source 1..16: mol_type = other DNA
actttcatagggagac

SEQ ID NO: 2097 - DNA, 16 bp, synthetic construct
  source 1..16: mol_type = other DNA
aaggatttctaggatg

SEQ ID NO: 2098 - DNA, 16 bp, synthetic construct
  source 1..16: mol_type = other DNA
ttagttggtagcttgc

SEQ ID NO: 2099 - DNA, 16 bp, synthetic construct
  source 1..16: mol_type = other DNA
tcccacaaaactaacc

SEQ ID NO: 2100 - DNA, 16 bp, synthetic construct
  source 1..16: mol_type = other DNA
tagaactcccaaccca

SEQ ID NO: 2101 - DNA, 16 bp, synthetic construct
  source 1..16: mol_type = other DNA
ttacccctggcttttc

SEQ ID NO: 2102 - DNA, 16 bp, synthetic construct
  source 1..16: mol_type = other DNA
actacttcagttagca

SEQ ID NO: 2103 - DNA, 16 bp, synthetic construct
  source 1..16: mol_type = other DNA
gacagaccaagtagct

SEQ ID NO: 2104 - DNA, 16 bp, synthetic construct
  source 1..16: mol_type = other DNA
cttccaagcattccat

SEQ ID NO: 2105 - DNA, 16 bp, synthetic construct
  source 1..16: mol_type = other DNA
ccgaaaaaagtggagg

SEQ ID NO: 2106 - DNA, 16 bp, synthetic construct
  source 1..16: mol_type = other DNA
aagactttgagactct

SEQ ID NO: 2107 - DNA, 16 bp, synthetic construct
  source 1..16: mol_type = other DNA
cactttcactgggtgt

SEQ ID NO: 2108 - DNA, 16 bp, synthetic construct
  source 1..16: mol_type = other DNA
tccaggttgagataaa

SEQ ID NO: 2109 - DNA, 16 bp, synthetic construct
  source 1..16: mol_type = other DNA
tcacctttcataatgt

SEQ ID NO: 2110 - DNA, 16 bp, synthetic construct
  source 1..16: mol_type = other DNA
ttgttaagcagatggc

SEQ ID NO: 2111 - DNA, 16 bp, synthetic construct
  source 1..16: mol_type = other DNA
ctactttcaaaccttg

SEQ ID NO: 2112 - DNA, 16 bp, synthetic construct
  source 1..16: mol_type = other DNA
tgctatagtaatcaca

SEQ ID NO: 2113 - DNA, 16 bp, synthetic construct
  source 1..16: mol_type = other DNA
cctttagttagaatag

SEQ ID NO: 2114 - DNA, 16 bp, synthetic construct
  source 1..16: mol_type = other DNA
attgtttagctgatag

SEQ ID NO: 2115 - DNA, 16 bp, synthetic construct
  source 1..16: mol_type = other DNA
tgttaacctgcagcag

SEQ ID NO: 2116 - DNA, 16 bp, synthetic construct
  source 1..16: mol_type = other DNA
tgattgagttctccac

SEQ ID NO: 2117 - DNA, 16 bp, synthetic construct
  source 1..16: mol_type = other DNA
acataccactcttctc

SEQ ID NO: 2118 - DNA, 16 bp, synthetic construct
  source 1..16: mol_type = other DNA
ttagaaactgctcctc

SEQ ID NO: 2119 - DNA, 16 bp, synthetic construct
  source 1..16: mol_type = other DNA
ttgttagagtgcttag

SEQ ID NO: 2120 - DNA, 16 bp, synthetic construct
  source 1..16: mol_type = other DNA
cttgacaatggttgcc

SEQ ID NO: 2121 - DNA, 16 bp, synthetic construct
  source 1..16: mol_type = other DNA
atagatccttttttgg

SEQ ID NO: 2122 - DNA, 16 bp, synthetic construct
  source 1..16: mol_type = other DNA
acattcttcaggtgtt

SEQ ID NO: 2123 - DNA, 16 bp, synthetic construct
  source 1..16: mol_type = other DNA
ttgcagttattagaag

SEQ ID NO: 2124 - DNA, 16 bp, synthetic construct
  source 1..16: mol_type = other DNA
taagatgtccaggcat

SEQ ID NO: 2125 - DNA, 16 bp, synthetic construct
  source 1..16: mol_type = other DNA
gaagtgtaatgctccc

SEQ ID NO: 2126 - DNA, 16 bp, synthetic construct
  source 1..16: mol_type = other DNA
tatttcttgcgagaaa

SEQ ID NO: 2127 - DNA, 16 bp, synthetic construct
  source 1..16: mol_type = other DNA
tttatagactgggtag

SEQ ID NO: 2128 - DNA, 16 bp, synthetic construct
  source 1..16: mol_type = other DNA
tttcttatgtaatagc

SEQ ID NO: 2129 - DNA, 16 bp, synthetic construct
  source 1..16: mol_type = other DNA
aaacatctctgggacc

SEQ ID NO: 2130 - DNA, 16 bp, synthetic construct
  source 1..16: mol_type = other DNA
agtgcatcttaagata

SEQ ID NO: 2131 - DNA, 16 bp, synthetic construct
  source 1..16: mol_type = other DNA
gaaactcacttcctac

SEQ ID NO: 2132 - DNA, 16 bp, synthetic construct
  source 1..16: mol_type = other DNA
aatacattagcaagct

SEQ ID NO: 2133 - DNA, 16 bp, synthetic construct
  source 1..16: mol_type = other DNA
agacatgaggttttga

SEQ ID NO: 2134 - DNA, 16 bp, synthetic construct
  source 1..16: mol_type = other DNA
gacaatgtgcagctct

SEQ ID NO: 2135 - DNA, 16 bp, synthetic construct
  source 1..16: mol_type = other DNA
taaagcaggctacttt

SEQ ID NO: 2136 - DNA, 16 bp, synthetic construct
  source 1..16: mol_type = other DNA
cataagagatgagtag

SEQ ID NO: 2137 - DNA, 16 bp, synthetic construct
  source 1..16: mol_type = other DNA
gagctagacaattgca

SEQ ID NO: 2138 - DNA, 16 bp, synthetic construct
  source 1..16: mol_type = other DNA
tagtgaacatacattg

SEQ ID NO: 2139 - DNA, 16 bp, synthetic construct
  source 1..16: mol_type = other DNA
gctgctatttagggca

SEQ ID NO: 2140 - DNA, 16 bp, synthetic construct
  source 1..16: mol_type = other DNA
ttctaggtcagtagag

SEQ ID NO: 2141 - DNA, 16 bp, synthetic construct
  source 1..16: mol_type = other DNA
taaaatatgtccaggt

SEQ ID NO: 2142 - DNA, 16 bp, synthetic construct
  source 1..16: mol_type = other DNA
agaccaaaaagatggc

SEQ ID NO: 2143 - DNA, 16 bp, synthetic construct
  source 1..16: mol_type = other DNA
aactctattgattggc

SEQ ID NO: 2144 - DNA, 16 bp, synthetic construct
  source 1..16: mol_type = other DNA
aattcaccttgactaa

SEQ ID NO: 2145 - DNA, 16 bp, synthetic construct
  source 1..16: mol_type = other DNA
atcaaatgtatgtgct

SEQ ID NO: 2146 - DNA, 16 bp, synthetic construct
  source 1..16: mol_type = other DNA
ctacagaggagtttgc

SEQ ID NO: 2147 - DNA, 16 bp, synthetic construct
  source 1..16: mol_type = other DNA
actccccaaacatgga

SEQ ID NO: 2148 - DNA, 16 bp, synthetic construct
  source 1..16: mol_type = other DNA
gctgagtggattacat

SEQ ID NO: 2149 - DNA, 16 bp, synthetic construct
  source 1..16: mol_type = other DNA
gtgctaagtagtaatt

SEQ ID NO: 2150 - DNA, 16 bp, synthetic construct
  source 1..16: mol_type = other DNA
tttcttattggtaagt

SEQ ID NO: 2151 - DNA, 16 bp, synthetic construct
  source 1..16: mol_type = other DNA
gagattacccctggct

SEQ ID NO: 2152 - DNA, 16 bp, synthetic construct
  source 1..16: mol_type = other DNA
actcgggaagtttaga

SEQ ID NO: 2153 - DNA, 16 bp, synthetic construct
  source 1..16: mol_type = other DNA
gttgatatttccatct

SEQ ID NO: 2154 - DNA, 16 bp, synthetic construct
  source 1..16: mol_type = other DNA
agcatcaagacattct

SEQ ID NO: 2155 - DNA, 16 bp, synthetic construct
  source 1..16: mol_type = other DNA
agtagtgtaagctgag

SEQ ID NO: 2156 - DNA, 16 bp, synthetic construct
  source 1..16: mol_type = other DNA
caggctgtaagagtca

SEQ ID NO: 2157 - DNA, 16 bp, synthetic construct
  source 1..16: mol_type = other DNA
gccaaactgctactgt

SEQ ID NO: 2158 - DNA, 16 bp, synthetic construct
  source 1..16: mol_type = other DNA
atatccagtaggtgtg

SEQ ID NO: 2159 - DNA, 16 bp, synthetic construct
  source 1..16: mol_type = other DNA
caagtttgttcatagt

SEQ ID NO: 2160 - DNA, 16 bp, synthetic construct
  source 1..16: mol_type = other DNA
tcttaaaccttccctg

SEQ ID NO: 2161 - DNA, 16 bp, synthetic construct
  source 1..16: mol_type = other DNA
aaagtgtcctcgatcc

SEQ ID NO: 2162 - DNA, 16 bp, synthetic construct
  source 1..16: mol_type = other DNA
tgagagaacttataca

SEQ ID NO: 2163 - DNA, 16 bp, synthetic construct
  source 1..16: mol_type = other DNA
tattcccaacgcaaca

SEQ ID NO: 2164 - DNA, 16 bp, synthetic construct
  source 1..16: mol_type = other DNA
acccgcccttaagtca

SEQ ID NO: 2165 - DNA, 16 bp, synthetic construct
  source 1..16: mol_type = other DNA
ataggagagtctttca

SEQ ID NO: 2166 - DNA, 16 bp, synthetic construct
  source 1..16: mol_type = other DNA
gcacatcatgttttgc

SEQ ID NO: 2167 - DNA, 16 bp, synthetic construct
  source 1..16: mol_type = other DNA
tacaccacactaatga

SEQ ID NO: 2168 - DNA, 16 bp, synthetic construct
  source 1..16: mol_type = other DNA
ctcagagttcaggcaa

SEQ ID NO: 2169 - DNA, 16 bp, synthetic construct
  source 1..16: mol_type = other DNA
gacagagcaatttact

SEQ ID NO: 2170 - DNA, 16 bp, synthetic construct
  source 1..16: mol_type = other DNA
actccgttataagttt

SEQ ID NO: 2171 - DNA, 16 bp, synthetic construct
  source 1..16: mol_type = other DNA
aaattcataagtagtc

SEQ ID NO: 2172 - DNA, 16 bp, synthetic construct
  source 1..16: mol_type = other DNA
ccttatgttatctcaa

SEQ ID NO: 2173 - DNA, 16 bp, synthetic construct
  source 1..16: mol_type = other DNA
ccttaccagaatttac

SEQ ID NO: 2174 - DNA, 16 bp, synthetic construct
  source 1..16: mol_type = other DNA
ccagagcattcatcag

SEQ ID NO: 2175 - DNA, 16 bp, synthetic construct
  source 1..16: mol_type = other DNA
gaaaagatgtacactg

SEQ ID NO: 2176 - DNA, 16 bp, synthetic construct
  source 1..16: mol_type = other DNA
ctaacctgacacatat

SEQ ID NO: 2177 - DNA, 16 bp, synthetic construct
  source 1..16: mol_type = other DNA
tttttaagaggcatga

SEQ ID NO: 2178 - DNA, 16 bp, synthetic construct
  source 1..16: mol_type = other DNA
aagagctggtaaaggt

SEQ ID NO: 2179 - DNA, 16 bp, synthetic construct
  source 1..16: mol_type = other DNA
gacttgcctcatttag

SEQ ID NO: 2180 - DNA, 16 bp, synthetic construct
  source 1..16: mol_type = other DNA
cctatgcaaattcata

SEQ ID NO: 2181 - DNA, 16 bp, synthetic construct
  source 1..16: mol_type = other DNA
aaggactttcataggg

SEQ ID NO: 2182 - DNA, 16 bp, synthetic construct
  source 1..16: mol_type = other DNA
cagtaaaattatgcct

SEQ ID NO: 2183 - DNA, 16 bp, synthetic construct
  source 1..16: mol_type = other DNA
aattttcagatcccgt

SEQ ID NO: 2184 - DNA, 16 bp, synthetic construct
  source 1..16: mol_type = other DNA
aagacagaccaagtag

SEQ ID NO: 2185 - DNA, 16 bp, synthetic construct
  source 1..16: mol_type = other DNA
acctctaagttagccc

SEQ ID NO: 2186 - DNA, 16 bp, synthetic construct
  source 1..16: mol_type = other DNA
caaaagactttgagac

SEQ ID NO: 2187 - DNA, 16 bp, synthetic construct
  source 1..16: mol_type = other DNA
aatacgctgagagtta

SEQ ID NO: 2188 - DNA, 16 bp, synthetic construct
  source 1..16: mol_type = other DNA
ttccgaaaaaagtgga

SEQ ID NO: 2189 - DNA, 16 bp, synthetic construct
  source 1..16: mol_type = other DNA
cgtcaaatagggctgg

SEQ ID NO: 2190 - DNA, 16 bp, synthetic construct
  source 1..16: mol_type = other DNA
cttcactatattgcat

SEQ ID NO: 2191 - DNA, 16 bp, synthetic construct
  source 1..16: mol_type = other DNA
cagcatcaagacattc

SEQ ID NO: 2192 - DNA, 16 bp, synthetic construct
  source 1..16: mol_type = other DNA
ttttatagactgggta

SEQ ID NO: 2193 - DNA, 16 bp, synthetic construct
  source 1..16: mol_type = other DNA
atagttcaaattggat

SEQ ID NO: 2194 - DNA, 16 bp, synthetic construct
  source 1..16: mol_type = other DNA
tgttttagtatttggg

SEQ ID NO: 2195 - DNA, 16 bp, synthetic construct
  source 1..16: mol_type = other DNA
caccatgacagcttca

SEQ ID NO: 2196 - DNA, 16 bp, synthetic construct
  source 1..16: mol_type = other DNA
cttctgtaggttttgc

SEQ ID NO: 2197 - DNA, 16 bp, synthetic construct
  source 1..16: mol_type = other DNA
tagttatcttctcact

SEQ ID NO: 2198 - DNA, 16 bp, synthetic construct
  source 1..16: mol_type = other DNA
atgcaaaagcattcta

SEQ ID NO: 2199 - DNA, 16 bp, synthetic construct
  source 1..16: mol_type = other DNA
tcttgacaatggttgc

SEQ ID NO: 2200 - DNA, 16 bp, synthetic construct
  source 1..16: mol_type = other DNA
taactctattgattgg

SEQ ID NO: 2201 - DNA, 16 bp, synthetic construct
  source 1..16: mol_type = other DNA
gacaacagagttctgt

SEQ ID NO: 2202 - DNA, 16 bp, synthetic construct
  source 1..16: mol_type = other DNA
gaaattcaccttgact

SEQ ID NO: 2203 - DNA, 16 bp, synthetic construct
  source 1..16: mol_type = other DNA
tggaatgctacttgaa

SEQ ID NO: 2204 - DNA, 16 bp, synthetic construct
  source 1..16: mol_type = other DNA
gagtagtgtaagctga

SEQ ID NO: 2205 - DNA, 16 bp, synthetic construct
  source 1..16: mol_type = other DNA
acggtgatcaaatgta

SEQ ID NO: 2206 - DNA, 16 bp, synthetic construct
  source 1..16: mol_type = other DNA
aaaaccgtcaaatagg

SEQ ID NO: 2207 - DNA, 16 bp, synthetic construct
  source 1..16: mol_type = other DNA
tattctccaactcagg

SEQ ID NO: 2208 - DNA, 16 bp, synthetic construct
  source 1..16: mol_type = other DNA
ctccttatgttatctc

SEQ ID NO: 2209 - DNA, 16 bp, synthetic construct
  source 1..16: mol_type = other DNA
tgttatcagaaactta

SEQ ID NO: 2210 - DNA, 16 bp, synthetic construct
  source 1..16: mol_type = other DNA
gctgtaattaggaaga

SEQ ID NO: 2211 - DNA, 16 bp, synthetic construct
  source 1..16: mol_type = other DNA
agaaccaggactctcc

SEQ ID NO: 2212 - DNA, 16 bp, synthetic construct
  source 1..16: mol_type = other DNA
caaattcataagtagt

SEQ ID NO: 2213 - DNA, 16 bp, synthetic construct
  source 1..16: mol_type = other DNA
aagaggctagggaaat

SEQ ID NO: 2214 - DNA, 16 bp, synthetic construct
  source 1..16: mol_type = other DNA
gacaactgatgtccag

SEQ ID NO: 2215 - DNA, 16 bp, synthetic construct
  source 1..16: mol_type = other DNA
gacagtaaaattatgc

SEQ ID NO: 2216 - DNA, 16 bp, synthetic construct
  source 1..16: mol_type = other DNA
ttgtaccctgttctca

SEQ ID NO: 2217 - DNA, 16 bp, synthetic construct
  source 1..16: mol_type = other DNA
aattaagatgtccagg

SEQ ID NO: 2218 - DNA, 16 bp, synthetic construct
  source 1..16: mol_type = other DNA
ttctacaccacactaa

SEQ ID NO: 2219 - DNA, 16 bp, synthetic construct
  source 1..16: mol_type = other DNA
agtttttaagaggcat

SEQ ID NO: 2220 - DNA, 16 bp, synthetic construct
  source 1..16: mol_type = other DNA
tcacaaagtccctgac

SEQ ID NO: 2221 - DNA, 16 bp, synthetic construct
  source 1..16: mol_type = other DNA
catgaagattagttaa

SEQ ID NO: 2222 - DNA, 16 bp, synthetic construct
  source 1..16: mol_type = other DNA
tctcagagttcaggca

SEQ ID NO: 2223 - DNA, 16 bp, synthetic construct
  source 1..16: mol_type = other DNA
gtttctaggtcagtag

SEQ ID NO: 2224 - DNA, 16 bp, synthetic construct
  source 1..16: mol_type = other DNA
agtgctaagtagtaat

SEQ ID NO: 2225 - DNA, 16 bp, synthetic construct
  source 1..16: mol_type = other DNA
taaaccctggagcagc

SEQ ID NO: 2226 - DNA, 16 bp, synthetic construct
  source 1..16: mol_type = other DNA
agccaaactgctactg

SEQ ID NO: 2227 - DNA, 16 bp, synthetic construct
  source 1..16: mol_type = other DNA
tgtgaagagctggtaa

SEQ ID NO: 2228 - DNA, 16 bp, synthetic construct
  source 1..16: mol_type = other DNA
agaaggactttcatag

SEQ ID NO: 2229 - DNA, 16 bp, synthetic construct
  source 1..16: mol_type = other DNA
aagtttgttagagtgc

SEQ ID NO: 2230 - DNA, 16 bp, synthetic construct
  source 1..16: mol_type = other DNA
ccagtaaaaaattggt

SEQ ID NO: 2231 - DNA, 16 bp, synthetic construct
  source 1..16: mol_type = other DNA
attatttcttgcgaga

SEQ ID NO: 2232 - DNA, 16 bp, synthetic construct
  source 1..16: mol_type = other DNA
aaaagtgtcctcgatc

SEQ ID NO: 2233 - DNA, 16 bp, synthetic construct
  source 1..16: mol_type = other DNA
aagaataggagagtct

SEQ ID NO: 2234 - DNA, 16 bp, synthetic construct
  source 1..16: mol_type = other DNA
gacttttgtttgtagc

SEQ ID NO: 2235 - DNA, 16 bp, synthetic construct
  source 1..16: mol_type = other DNA
tacattcttcaggtgt

SEQ ID NO: 2236 - DNA, 16 bp, synthetic construct
  source 1..16: mol_type = other DNA
tgagctagacaattgc

SEQ ID NO: 2237 - DNA, 16 bp, synthetic construct
  source 1..16: mol_type = other DNA
agagacatgaggtttt

SEQ ID NO: 2238 - DNA, 16 bp, synthetic construct
  source 1..16: mol_type = other DNA
attgcagttattagaa

SEQ ID NO: 2239 - DNA, 16 bp, synthetic construct
  source 1..16: mol_type = other DNA
ccttcatctaactaac

SEQ ID NO: 2240 - DNA, 16 bp, synthetic construct
  source 1..16: mol_type = other DNA
ctcaggctgtaagagt

SEQ ID NO: 2241 - DNA, 16 bp, synthetic construct
  source 1..16: mol_type = other DNA
accgtattcccaacgc

SEQ ID NO: 2242 - DNA, 16 bp, synthetic construct
  source 1..16: mol_type = other DNA
aactccgttataagtt

SEQ ID NO: 2243 - DNA, 16 bp, synthetic construct
  source 1..16: mol_type = other DNA
cccctaagttattatc

SEQ ID NO: 2244 - DNA, 16 bp, synthetic construct
  source 1..16: mol_type = other DNA
tgtgagaggatagtga

SEQ ID NO: 2245 - DNA, 16 bp, synthetic construct
  source 1..16: mol_type = other DNA
aactgaaacgatcctc

SEQ ID NO: 2246 - DNA, 16 bp, synthetic construct
  source 1..16: mol_type = other DNA
ggcagttgaagttgat

SEQ ID NO: 2247 - DNA, 16 bp, synthetic construct
  source 1..16: mol_type = other DNA
gtgggataaactgttc

SEQ ID NO: 2248 - DNA, 16 bp, synthetic construct
  source 1..16: mol_type = other DNA
tagctattgtctttga

SEQ ID NO: 2249 - DNA, 16 bp, synthetic construct
  source 1..16: mol_type = other DNA
tacctctaagttagcc

SEQ ID NO: 2250 - DNA, 16 bp, synthetic construct
  source 1..16: mol_type = other DNA
gtgattgagttctcca

SEQ ID NO: 2251 - DNA, 16 bp, synthetic construct
  source 1..16: mol_type = other DNA
caagacagaccaagta

SEQ ID NO: 2252 - DNA, 16 bp, synthetic construct
  source 1..16: mol_type = other DNA
agctgagtggattaca

SEQ ID NO: 2253 - DNA, 16 bp, synthetic construct
  source 1..16: mol_type = other DNA
ataggacatggagaca

SEQ ID NO: 2254 - DNA, 16 bp, synthetic construct
  source 1..16: mol_type = other DNA
taccagagcattcatc

SEQ ID NO: 2255 - DNA, 16 bp, synthetic construct
  source 1..16: mol_type = other DNA
ttgagagaacttatac

SEQ ID NO: 2256 - DNA, 16 bp, synthetic construct
  source 1..16: mol_type = other DNA
gagtgcatcttaagat

SEQ ID NO: 2257 - DNA, 16 bp, synthetic construct
  source 1..16: mol_type = other DNA
gccttaccagaattta

SEQ ID NO: 2258 - DNA, 16 bp, synthetic construct
  source 1..16: mol_type = other DNA
aatcctatgcaaattc

SEQ ID NO: 2259 - DNA, 16 bp, synthetic construct
  source 1..16: mol_type = other DNA
ctaaacatctctggga

SEQ ID NO: 2260 - DNA, 16 bp, synthetic construct
  source 1..16: mol_type = other DNA
cgaatttcttcaaaga

SEQ ID NO: 2261 - DNA, 16 bp, synthetic construct
  source 1..16: mol_type = other DNA
aaagccctattcttcg

SEQ ID NO: 2262 - DNA, 16 bp, synthetic construct
  source 1..16: mol_type = other DNA
tgtacagtaggcagtt

SEQ ID NO: 2263 - DNA, 16 bp, synthetic construct
  source 1..16: mol_type = other DNA
caagtgacagcattga

SEQ ID NO: 2264 - DNA, 16 bp, synthetic construct
  source 1..16: mol_type = other DNA
atgagattacccctgg

SEQ ID NO: 2265 - DNA, 16 bp, synthetic construct
  source 1..16: mol_type = other DNA
aacactaatctcagta

SEQ ID NO: 2266 - DNA, 16 bp, synthetic construct
  source 1..16: mol_type = other DNA
taatacattagcaagc

SEQ ID NO: 2267 - DNA, 16 bp, synthetic construct
  source 1..16: mol_type = other DNA
ctacctctaagttagc

SEQ ID NO: 2268 - DNA, 16 bp, synthetic construct
  source 1..16: mol_type = other DNA
gaagaggctagggaaa

SEQ ID NO: 2269 - DNA, 16 bp, synthetic construct
  source 1..16: mol_type = other DNA
tatacctgttgcctag

SEQ ID NO: 2270 - DNA, 16 bp, synthetic construct
  source 1..16: mol_type = other DNA
catatggtgtacactg

SEQ ID NO: 2271 - DNA, 16 bp, synthetic construct
  source 1..16: mol_type = other DNA
gtcaaaaaccgtcaaa

SEQ ID NO: 2272 - DNA, 16 bp, synthetic construct
  source 1..16: mol_type = other DNA
aatatcccacagaacc

SEQ ID NO: 2273 - DNA, 16 bp, synthetic construct
  source 1..16: mol_type = other DNA
ataactctattgattg

SEQ ID NO: 2274 - DNA, 16 bp, synthetic construct
  source 1..16: mol_type = other DNA
tgccaagctttgtgtc

SEQ ID NO: 2275 - DNA, 16 bp, synthetic construct
  source 1..16: mol_type = other DNA
ccgaattatttcttgc

SEQ ID NO: 2276 - DNA, 16 bp, synthetic construct
  source 1..16: mol_type = other DNA
aaagttcattcgaatt

SEQ ID NO: 2277 - DNA, 16 bp, synthetic construct
  source 1..16: mol_type = other DNA
accaatgcagtttgta

SEQ ID NO: 2278 - DNA, 16 bp, synthetic construct
  source 1..16: mol_type = other DNA
taaagtgctaagtagt

SEQ ID NO: 2279 - DNA, 16 bp, synthetic construct
  source 1..16: mol_type = other DNA
gtttttctcttgacaa

SEQ ID NO: 2280 - DNA, 16 bp, synthetic construct
  source 1..16: mol_type = other DNA
gctctattgggccagg

SEQ ID NO: 2281 - DNA, 16 bp, synthetic construct
  source 1..16: mol_type = other DNA
cgcgagatgatgttgc

SEQ ID NO: 2282 - DNA, 16 bp, synthetic construct
  source 1..16: mol_type = other DNA
tactattctccaactc

SEQ ID NO: 2283 - DNA, 16 bp, synthetic construct
  source 1..16: mol_type = other DNA
aagtttttaagaggca

SEQ ID NO: 2284 - DNA, 16 bp, synthetic construct
  source 1..16: mol_type = other DNA
agaaattcaccttgac

SEQ ID NO: 2285 - DNA, 16 bp, synthetic construct
  source 1..16: mol_type = other DNA
tctttttatagactgg

SEQ ID NO: 2286 - DNA, 16 bp, synthetic construct
  source 1..16: mol_type = other DNA
gacatagacatgtgtt

SEQ ID NO: 2287 - DNA, 16 bp, synthetic construct
  source 1..16: mol_type = other DNA
tctaaacatctctggg

SEQ ID NO: 2288 - DNA, 16 bp, synthetic construct
  source 1..16: mol_type = other DNA
aacctatgtgtgcacc

SEQ ID NO: 2289 - DNA, 16 bp, synthetic construct
  source 1..16: mol_type = other DNA
taacggtgatcaaatg

SEQ ID NO: 2290 - DNA, 16 bp, synthetic construct
  source 1..16: mol_type = other DNA
tttgagagaacttata

SEQ ID NO: 2291 - DNA, 16 bp, synthetic construct
  source 1..16: mol_type = other DNA
agtatgtgaactccgt

SEQ ID NO: 2292 - DNA, 16 bp, synthetic construct
  source 1..16: mol_type = other DNA
ttaccagagcattcat

SEQ ID NO: 2293 - DNA, 16 bp, synthetic construct
  source 1..16: mol_type = other DNA
tgagtagtgtaagctg

SEQ ID NO: 2294 - DNA, 16 bp, synthetic construct
  source 1..16: mol_type = other DNA
tgggatagtggaggaa

SEQ ID NO: 2295 - DNA, 16 bp, synthetic construct
  source 1..16: mol_type = other DNA
tatagttatcttctca

SEQ ID NO: 2296 - DNA, 16 bp, synthetic construct
  source 1..16: mol_type = other DNA
ataatacattagcaag

SEQ ID NO: 2297 - DNA, 16 bp, synthetic construct
  source 1..16: mol_type = other DNA
ggctaaaccctggagc

SEQ ID NO: 2298 - DNA, 16 bp, synthetic construct
  source 1..16: mol_type = other DNA
tattgtagggattgaa

SEQ ID NO: 2299 - DNA, 16 bp, synthetic construct
  source 1..16: mol_type = other DNA
ctgttgcaagttcttc

SEQ ID NO: 2300 - DNA, 16 bp, synthetic construct
  source 1..16: mol_type = other DNA
tttactcacttctggt

SEQ ID NO: 2301 - DNA, 16 bp, synthetic construct
  source 1..16: mol_type = other DNA
cacatagctaactcag

SEQ ID NO: 2302 - DNA, 16 bp, synthetic construct
  source 1..16: mol_type = other DNA
gaaccgtattcccaac

SEQ ID NO: 2303 - DNA, 16 bp, synthetic construct
  source 1..16: mol_type = other DNA
aggcagttgaagttga

SEQ ID NO: 2304 - DNA, 16 bp, synthetic construct
  source 1..16: mol_type = other DNA
ttaatgccaccctacc

SEQ ID NO: 2305 - DNA, 16 bp, synthetic construct
  source 1..16: mol_type = other DNA
gattgcacaaaccaca

SEQ ID NO: 2306 - DNA, 16 bp, synthetic construct
  source 1..16: mol_type = other DNA
ctaggagatataacat

SEQ ID NO: 2307 - DNA, 16 bp, synthetic construct
  source 1..16: mol_type = other DNA
ctgaaaagccctattc

SEQ ID NO: 2308 - DNA, 16 bp, synthetic construct
  source 1..16: mol_type = other DNA
aatttgtgaacctgca

SEQ ID NO: 2309 - DNA, 16 bp, synthetic construct
  source 1..16: mol_type = other DNA
acattgcagttattag

SEQ ID NO: 2310 - DNA, 16 bp, synthetic construct
  source 1..16: mol_type = other DNA
gcttagtgtagaattg

SEQ ID NO: 2311 - DNA, 16 bp, synthetic construct
  source 1..16: mol_type = other DNA
caatgagattacccct

SEQ ID NO: 2312 - DNA, 16 bp, synthetic construct
  source 1..16: mol_type = other DNA
gatgattctgactcat

SEQ ID NO: 2313 - DNA, 16 bp, synthetic construct
  source 1..16: mol_type = other DNA
tcattaggaaaagtgt

SEQ ID NO: 2314 - DNA, 16 bp, synthetic construct
  source 1..16: mol_type = other DNA
aaaggtgggataaact

SEQ ID NO: 2315 - DNA, 16 bp, synthetic construct
  source 1..16: mol_type = other DNA
gccaacactaatctca

SEQ ID NO: 2316 - DNA, 16 bp, synthetic construct
  source 1..16: mol_type = other DNA
acagcatcaagacatt

SEQ ID NO: 2317 - DNA, 16 bp, synthetic construct
  source 1..16: mol_type = other DNA
tgaactgaaacgatcc

SEQ ID NO: 2318 - DNA, 16 bp, synthetic construct
  source 1..16: mol_type = other DNA
acaagtgacagcattg

SEQ ID NO: 2319 - DNA, 16 bp, synthetic construct
  source 1..16: mol_type = other DNA
cagagacatgaggttt

SEQ ID NO: 2320 - DNA, 16 bp, synthetic construct
  source 1..16: mol_type = other DNA
tatgtgaagagctggt

SEQ ID NO: 2321 - DNA, 16 bp, synthetic construct
  source 1..16: mol_type = other DNA
atcccctaagttatta

SEQ ID NO: 2322 - DNA, 16 bp, synthetic construct
  source 1..16: mol_type = other DNA
ggattgcagaagagta

SEQ ID NO: 2323 - DNA, 16 bp, synthetic construct
  source 1..16: mol_type = other DNA
tgacaacagagttctg

SEQ ID NO: 2324 - DNA, 16 bp, synthetic construct
  source 1..16: mol_type = other DNA
taaactaaagtacttg

SEQ ID NO: 2325 - DNA, 16 bp, synthetic construct
  source 1..16: mol_type = other DNA
tggccttaccagaatt

SEQ ID NO: 2326 - DNA, 16 bp, synthetic construct
  source 1..16: mol_type = other DNA
gacatgaagattagtt

SEQ ID NO: 2327 - DNA, 16 bp, synthetic construct
  source 1..16: mol_type = other DNA
ctgtgagaggatagtg

SEQ ID NO: 2328 - DNA, 16 bp, synthetic construct
  source 1..16: mol_type = other DNA
attctgtggcatggct

SEQ ID NO: 2329 - DNA, 16 bp, synthetic construct
  source 1..16: mol_type = other DNA
ccatgcaaaagcattc

SEQ ID NO: 2330 - DNA, 16 bp, synthetic construct
  source 1..16: mol_type = other DNA
aatcgctgcttagttc

SEQ ID NO: 2331 - DNA, 16 bp, synthetic construct
  source 1..16: mol_type = other DNA
cagttttcctcatgat

SEQ ID NO: 2332 - DNA, 16 bp, synthetic construct
  source 1..16: mol_type = other DNA
atgtgattgagttctc

SEQ ID NO: 2333 - DNA, 16 bp, synthetic construct
  source 1..16: mol_type = other DNA
ctatctccctatttgt

SEQ ID NO: 2334 - DNA, 16 bp, synthetic construct
  source 1..16: mol_type = other DNA
gatccatattccctga

SEQ ID NO: 2335 - DNA, 16 bp, synthetic construct
  source 1..16: mol_type = other DNA
ctgagctagacaattg

SEQ ID NO: 2336 - DNA, 16 bp, synthetic construct
  source 1..16: mol_type = other DNA
tgtatgaggtctctca

SEQ ID NO: 2337 - DNA, 16 bp, synthetic construct
  source 1..16: mol_type = other DNA
ccaaacttgcccataa

SEQ ID NO: 2338 - DNA, 16 bp, synthetic construct
  source 1..16: mol_type = other DNA
agagccaaactgctac

SEQ ID NO: 2339 - DNA, 16 bp, synthetic construct
  source 1..16: mol_type = other DNA
tagaacacttgcctca

SEQ ID NO: 2340 - DNA, 16 bp, synthetic construct
  source 1..16: mol_type = other DNA
gagttctacaccacac

SEQ ID NO: 2341 - DNA, 16 bp, synthetic construct
  source 1..16: mol_type = other DNA
ctacttcactatattg

SEQ ID NO: 2342 - DNA, 16 bp, synthetic construct
  source 1..16: mol_type = other DNA
gctgtacagtaggcag

SEQ ID NO: 2343 - DNA, 16 bp, synthetic construct
  source 1..16: mol_type = other DNA
gattaattcccttcca

SEQ ID NO: 2344 - DNA, 16 bp, synthetic construct
  source 1..16: mol_type = other DNA
ctggaaggaggattca

SEQ ID NO: 2345 - DNA, 16 bp, synthetic construct
  source 1..16: mol_type = other DNA
gtaacggtgatcaaat

SEQ ID NO: 2346 - DNA, 16 bp, synthetic construct
  source 1..16: mol_type = other DNA
ttgagtagtgtaagct

SEQ ID NO: 2347 - DNA, 16 bp, synthetic construct
  source 1..16: mol_type = other DNA
acatatgtgaagagct

SEQ ID NO: 2348 - DNA, 16 bp, synthetic construct
  source 1..16: mol_type = other DNA
cagaagtttttaagag

SEQ ID NO: 2349 - DNA, 16 bp, synthetic construct
  source 1..16: mol_type = other DNA
gaacctatgtgtgcac

SEQ ID NO: 2350 - DNA, 16 bp, synthetic construct
  source 1..16: mol_type = other DNA
cttgatgattctgact

SEQ ID NO: 2351 - DNA, 16 bp, synthetic construct
  source 1..16: mol_type = other DNA
tagtggacttcattag

SEQ ID NO: 2352 - DNA, 16 bp, synthetic construct
  source 1..16: mol_type = other DNA
ctataatacattagca

SEQ ID NO: 2353 - DNA, 16 bp, synthetic construct
  source 1..16: mol_type = other DNA
cccgaattatttcttg

SEQ ID NO: 2354 - DNA, 16 bp, synthetic construct
  source 1..16: mol_type = other DNA
ctctttttatagactg

SEQ ID NO: 2355 - DNA, 16 bp, synthetic construct
  source 1..16: mol_type = other DNA
gtaaactaaagtactt

SEQ ID NO: 2356 - DNA, 16 bp, synthetic construct
  source 1..16: mol_type = other DNA
ataaggccgattcatg

SEQ ID NO: 2357 - DNA, 16 bp, synthetic construct
  source 1..16: mol_type = other DNA
atcagttttcctcatg

SEQ ID NO: 2358 - DNA, 16 bp, synthetic construct
  source 1..16: mol_type = other DNA
ctaaattattgcctga

SEQ ID NO: 2359 - DNA, 16 bp, synthetic construct
  source 1..16: mol_type = other DNA
gaagaaacctgtacaa

SEQ ID NO: 2360 - DNA, 16 bp, synthetic construct
  source 1..16: mol_type = other DNA
attaactacttcacta

SEQ ID NO: 2361 - DNA, 16 bp, synthetic construct
  source 1..16: mol_type = other DNA
taagcagaattgtgaa

SEQ ID NO: 2362 - DNA, 16 bp, synthetic construct
  source 1..16: mol_type = other DNA
ccaatatatactgaca

SEQ ID NO: 2363 - DNA, 16 bp, synthetic construct
  source 1..16: mol_type = other DNA
gtctacctctaagtta

SEQ ID NO: 2364 - DNA, 16 bp, synthetic construct
  source 1..16: mol_type = other DNA
cttgacaatggttgat

SEQ ID NO: 2365 - DNA, 16 bp, synthetic construct
  source 1..16: mol_type = other DNA
aatatatacctgttgc

SEQ ID NO: 2366 - DNA, 16 bp, synthetic construct
  source 1..16: mol_type = other DNA
ttagtatagttatctt

SEQ ID NO: 2367 - DNA, 16 bp, synthetic construct
  source 1..16: mol_type = other DNA
tatgtgattgagttct

SEQ ID NO: 2368 - DNA, 16 bp, synthetic construct
  source 1..16: mol_type = other DNA
ctcgcgagatgatgtt

SEQ ID NO: 2369 - DNA, 16 bp, synthetic construct
  source 1..16: mol_type = other DNA
taggcagtaaagtgct

SEQ ID NO: 2370 - DNA, 16 bp, synthetic construct
  source 1..16: mol_type = other DNA
tgatacaccaatgcag

SEQ ID NO: 2371 - DNA, 16 bp, synthetic construct
  source 1..16: mol_type = other DNA
aactgagctagacaat

SEQ ID NO: 2372 - DNA, 16 bp, synthetic construct
  source 1..16: mol_type = other DNA
tgtaccaaacttgccc

SEQ ID NO: 2373 - DNA, 16 bp, synthetic construct
  source 1..16: mol_type = other DNA
atgccaagctttgtgt

SEQ ID NO: 2374 - DNA, 16 bp, synthetic construct
  source 1..16: mol_type = other DNA
gttggaagatgtatac

SEQ ID NO: 2375 - DNA, 16 bp, synthetic construct
  source 1..16: mol_type = other DNA
gctgagagttctacac

SEQ ID NO: 2376 - DNA, 16 bp, synthetic construct
  source 1..16: mol_type = other DNA
taaaggtgggataaac

SEQ ID NO: 2377 - DNA, 16 bp, synthetic construct
  source 1..16: mol_type = other DNA
aattcactatctccct

SEQ ID NO: 2378 - DNA, 16 bp, synthetic construct
  source 1..16: mol_type = other DNA
ttgttgatattctgtg

SEQ ID NO: 2379 - DNA, 16 bp, synthetic construct
  source 1..16: mol_type = other DNA
tgaaccgtattcccaa

SEQ ID NO: 2380 - DNA, 16 bp, synthetic construct
  source 1..16: mol_type = other DNA
ttggttggaggctgta

SEQ ID NO: 2381 - DNA, 16 bp, synthetic construct
  source 1..16: mol_type = other DNA
gctgcattaatgccac

SEQ ID NO: 2382 - DNA, 16 bp, synthetic construct
  source 1..16: mol_type = other DNA
tgcaatgagattaccc

SEQ ID NO: 2383 - DNA, 16 bp, synthetic construct
  source 1..16: mol_type = other DNA
cagaaattcaccttga

SEQ ID NO: 2384 - DNA, 16 bp, synthetic construct
  source 1..16: mol_type = other DNA
tctaggagatataaca

SEQ ID NO: 2385 - DNA, 16 bp, synthetic construct
  source 1..16: mol_type = other DNA
gagaattgtttagttc

SEQ ID NO: 2386 - DNA, 16 bp, synthetic construct
  source 1..16: mol_type = other DNA
ccagattgcacaaacc

SEQ ID NO: 2387 - DNA, 16 bp, synthetic construct
  source 1..16: mol_type = other DNA
tgccaacactaatctc

SEQ ID NO: 2388 - DNA, 16 bp, synthetic construct
  source 1..16: mol_type = other DNA
tggaagattaatcata

SEQ ID NO: 2389 - DNA, 16 bp, synthetic construct
  source 1..16: mol_type = other DNA
tccatgcaaaagcatt

SEQ ID NO: 2390 - DNA, 16 bp, synthetic construct
  source 1..16: mol_type = other DNA
aagttaccagagcatt

SEQ ID NO: 2391 - DNA, 16 bp, synthetic construct
  source 1..16: mol_type = other DNA
ggatacctgaaaagcc

SEQ ID NO: 2392 - DNA, 16 bp, synthetic construct
  source 1..16: mol_type = other DNA
gcagagacatgaggtt

SEQ ID NO: 2393 - DNA, 16 bp, synthetic construct
  source 1..16: mol_type = other DNA
tttcatggccttacca

SEQ ID NO: 2394 - DNA, 16 bp, synthetic construct
  source 1..16: mol_type = other DNA
ttggacatgaagatta

SEQ ID NO: 2395 - DNA, 16 bp, synthetic construct
  source 1..16: mol_type = other DNA
aggcactaaaggtttc

SEQ ID NO: 2396 - DNA, 16 bp, synthetic construct
  source 1..16: mol_type = other DNA
ggacaaatgcctgaga

SEQ ID NO: 2397 - DNA, 16 bp, synthetic construct
  source 1..16: mol_type = other DNA
gtttactcacttctgg

SEQ ID NO: 2398 - DNA, 16 bp, synthetic construct
  source 1..16: mol_type = other DNA
gagttattgtagggat

SEQ ID NO: 2399 - DNA, 16 bp, synthetic construct
  source 1..16: mol_type = other DNA
ttgtatgaggtctctc

SEQ ID NO: 2400 - DNA, 16 bp, synthetic construct
  source 1..16: mol_type = other DNA
gaaatttgtgaacctg

SEQ ID NO: 2401 - DNA, 16 bp, synthetic construct
  source 1..16: mol_type = other DNA
ctacctccaaattccc

SEQ ID NO: 2402 - DNA, 16 bp, synthetic construct
  source 1..16: mol_type = other DNA
gaagtgatccatattc

SEQ ID NO: 2403 - DNA, 16 bp, synthetic construct
  source 1..16: mol_type = other DNA
tctttagtcaacagta

SEQ ID NO: 2404 - DNA, 16 bp, synthetic construct
  source 1..16: mol_type = other DNA
ctgggatactattctc

SEQ ID NO: 2405 - DNA, 16 bp, synthetic construct
  source 1..16: mol_type = other DNA
taggcttagtgtagaa

SEQ ID NO: 2406 - DNA, 16 bp, synthetic construct
  source 1..16: mol_type = other DNA
ccaagtaattacttct

SEQ ID NO: 2407 - DNA, 16 bp, synthetic construct
  source 1..16: mol_type = other DNA
aaggaagaggctaggg

SEQ ID NO: 2408 - DNA, 16 bp, synthetic construct
  source 1..16: mol_type = other DNA
tcccctcaaatagcct

SEQ ID NO: 2409 - DNA, 16 bp, synthetic construct
  source 1..16: mol_type = other DNA
ttacagcatcaagaca

SEQ ID NO: 2410 - DNA, 16 bp, synthetic construct
  source 1..16: mol_type = other DNA
aataatagctctattg

SEQ ID NO: 2411 - DNA, 16 bp, synthetic construct
  source 1..16: mol_type = other DNA
tgtccagaagtatgtg

SEQ ID NO: 2412 - DNA, 16 bp, synthetic construct
  source 1..16: mol_type = other DNA
aagagccaaactgcta

SEQ ID NO: 2413 - DNA, 16 bp, synthetic construct
  source 1..16: mol_type = other DNA
tcaacctgcacaccat

SEQ ID NO: 2414 - DNA, 16 bp, synthetic construct
  source 1..16: mol_type = other DNA
gtaggctaaaccctgg

SEQ ID NO: 2415 - DNA, 16 bp, synthetic construct
  source 1..16: mol_type = other DNA
atgttttgatccaggg

SEQ ID NO: 2416 - DNA, 16 bp, synthetic construct
  source 1..16: mol_type = other DNA
ttgtctaaacatctct

SEQ ID NO: 2417 - DNA, 16 bp, synthetic construct
  source 1..16: mol_type = other DNA
catcccctaagttatt

SEQ ID NO: 2418 - DNA, 16 bp, synthetic construct
  source 1..16: mol_type = other DNA
ccatggatctagaaca

SEQ ID NO: 2419 - DNA, 16 bp, synthetic construct
  source 1..16: mol_type = other DNA
cgttaggtttccaaat

SEQ ID NO: 2420 - DNA, 16 bp, synthetic construct
  source 1..16: mol_type = other DNA
tagagtgaatcattca

SEQ ID NO: 2421 - DNA, 16 bp, synthetic construct
  source 1..16: mol_type = other DNA
taatcttgaggcagga

SEQ ID NO: 2422 - DNA, 16 bp, synthetic construct
  source 1..16: mol_type = other DNA
ggtaacggtgatcaaa

SEQ ID NO: 2423 - DNA, 16 bp, synthetic construct
  source 1..16: mol_type = other DNA
tctacactaatattga

SEQ ID NO: 2424 - DNA, 16 bp, synthetic construct
  source 1..16: mol_type = other DNA
ccccgaattatttctt

SEQ ID NO: 2425 - DNA, 16 bp, synthetic construct
  source 1..16: mol_type = other DNA
caaccaaacttccagc

SEQ ID NO: 2426 - DNA, 16 bp, synthetic construct
  source 1..16: mol_type = other DNA
tgcagaaattcacctt

SEQ ID NO: 2427 - DNA, 16 bp, synthetic construct
  source 1..16: mol_type = other DNA
cttctattgtatgagg

SEQ ID NO: 2428 - DNA, 16 bp, synthetic construct
  source 1..16: mol_type = other DNA
tcttacatgattaagc

SEQ ID NO: 2429 - DNA, 16 bp, synthetic construct
  source 1..16: mol_type = other DNA
taaaatagggtgcagt

SEQ ID NO: 2430 - DNA, 16 bp, synthetic construct
  source 1..16: mol_type = other DNA
attacagcatcaagac

SEQ ID NO: 2431 - DNA, 16 bp, synthetic construct
  source 1..16: mol_type = other DNA
ttatgtgattgagttc

SEQ ID NO: 2432 - DNA, 16 bp, synthetic construct
  source 1..16: mol_type = other DNA
atttttggtgaaccca

SEQ ID NO: 2433 - DNA, 16 bp, synthetic construct
  source 1..16: mol_type = other DNA
cgtttactcacttctg

SEQ ID NO: 2434 - DNA, 16 bp, synthetic construct
  source 1..16: mol_type = other DNA
ataataatagctctat

SEQ ID NO: 2435 - DNA, 16 bp, synthetic construct
  source 1..16: mol_type = other DNA
tttatgtaagcacaga

SEQ ID NO: 2436 - DNA, 16 bp, synthetic construct
  source 1..16: mol_type = other DNA
atagtccatgcaaaag

SEQ ID NO: 2437 - DNA, 16 bp, synthetic construct
  source 1..16: mol_type = other DNA
attctgtgttcttgtt

SEQ ID NO: 2438 - DNA, 16 bp, synthetic construct
  source 1..16: mol_type = other DNA
aagttagtatagttat

SEQ ID NO: 2439 - DNA, 16 bp, synthetic construct
  source 1..16: mol_type = other DNA
tagcaatttagcaaga

SEQ ID NO: 2440 - DNA, 16 bp, synthetic construct
  source 1..16: mol_type = other DNA
tcttgacaatggttga

SEQ ID NO: 2441 - DNA, 16 bp, synthetic construct
  source 1..16: mol_type = other DNA
tattatgcactctata

SEQ ID NO: 2442 - DNA, 16 bp, synthetic construct
  source 1..16: mol_type = other DNA
ttttactgggatacta

SEQ ID NO: 2443 - DNA, 16 bp, synthetic construct
  source 1..16: mol_type = other DNA
ttgaattcactatctc

SEQ ID NO: 2444 - DNA, 16 bp, synthetic construct
  source 1..16: mol_type = other DNA
ttgaaccgtattccca

SEQ ID NO: 2445 - DNA, 16 bp, synthetic construct
  source 1..16: mol_type = other DNA
acagttgagtagtgta

SEQ ID NO: 2446 - DNA, 16 bp, synthetic construct
  source 1..16: mol_type = other DNA
aatcagttttcctcat

SEQ ID NO: 2447 - DNA, 16 bp, synthetic construct
  source 1..16: mol_type = other DNA
ttcatagtggacttca

SEQ ID NO: 2448 - DNA, 16 bp, synthetic construct
  source 1..16: mol_type = other DNA
cacaagtaaggtaaag

SEQ ID NO: 2449 - DNA, 16 bp, synthetic construct
  source 1..16: mol_type = other DNA
ctagttgcaatgagat

SEQ ID NO: 2450 - DNA, 16 bp, synthetic construct
  source 1..16: mol_type = other DNA
ggtaagccccatgcca

SEQ ID NO: 2451 - DNA, 16 bp, synthetic construct
  source 1..16: mol_type = other DNA
cacaagcacactgtaa

SEQ ID NO: 2452 - DNA, 16 bp, synthetic construct
  source 1..16: mol_type = other DNA
gccagattgcacaaac

SEQ ID NO: 2453 - DNA, 16 bp, synthetic construct
  source 1..16: mol_type = other DNA
gcagagacagtagatt

SEQ ID NO: 2454 - DNA, 16 bp, synthetic construct
  source 1..16: mol_type = other DNA
ttatgtaccaaacttg

SEQ ID NO: 2455 - DNA, 16 bp, synthetic construct
  source 1..16: mol_type = other DNA
aggatacctgaaaagc

SEQ ID NO: 2456 - DNA, 16 bp, synthetic construct
  source 1..16: mol_type = other DNA
aacataggcttagtgt

SEQ ID NO: 2457 - DNA, 16 bp, synthetic construct
  source 1..16: mol_type = other DNA
atcctgtaaacacttc

SEQ ID NO: 2458 - DNA, 16 bp, synthetic construct
  source 1..16: mol_type = other DNA
aggaagtgatccatat

SEQ ID NO: 2459 - DNA, 16 bp, synthetic construct
  source 1..16: mol_type = other DNA
aggcaaagatctggcc

SEQ ID NO: 2460 - DNA, 16 bp, synthetic construct
  source 1..16: mol_type = other DNA
gcaccccatggatcta

SEQ ID NO: 2461 - DNA, 16 bp, synthetic construct
  source 1..16: mol_type = other DNA
ttcagagttatacaga

SEQ ID NO: 2462 - DNA, 16 bp, synthetic construct
  source 1..16: mol_type = other DNA
ccatcccctaagttat

SEQ ID NO: 2463 - DNA, 16 bp, synthetic construct
  source 1..16: mol_type = other DNA
ctttgcagcattgatt

SEQ ID NO: 2464 - DNA, 16 bp, synthetic construct
  source 1..16: mol_type = other DNA
gaactgtgttgcttgt

SEQ ID NO: 2465 - DNA, 16 bp, synthetic construct
  source 1..16: mol_type = other DNA
tacgacaggtcatctt

SEQ ID NO: 2466 - DNA, 16 bp, synthetic construct
  source 1..16: mol_type = other DNA
atggtaaactgtatgc

SEQ ID NO: 2467 - DNA, 16 bp, synthetic construct
  source 1..16: mol_type = other DNA
attcacatatgtgaag

SEQ ID NO: 2468 - DNA, 16 bp, synthetic construct
  source 1..16: mol_type = other DNA
tttttggacaaatgcc

SEQ ID NO: 2469 - DNA, 16 bp, synthetic construct
  source 1..16: mol_type = other DNA
agaaatttgtgaacct

SEQ ID NO: 2470 - DNA, 16 bp, synthetic construct
  source 1..16: mol_type = other DNA
atgcaagatttacttc

SEQ ID NO: 2471 - DNA, 16 bp, synthetic construct
  source 1..16: mol_type = other DNA
ttagagtgaatcattc

SEQ ID NO: 2472 - DNA, 16 bp, synthetic construct
  source 1..16: mol_type = other DNA
tgctactctaggagat

SEQ ID NO: 2473 - DNA, 16 bp, synthetic construct
  source 1..16: mol_type = other DNA
cagtatcccctcaaat

SEQ ID NO: 2474 - DNA, 16 bp, synthetic construct
  source 1..16: mol_type = other DNA
aattgtctaaacatct

SEQ ID NO: 2475 - DNA, 16 bp, synthetic construct
  source 1..16: mol_type = other DNA
cagagttattgtaggg

SEQ ID NO: 2476 - DNA, 16 bp, synthetic construct
  source 1..16: mol_type = other DNA
attgcataagagccaa

SEQ ID NO: 2477 - DNA, 16 bp, synthetic construct
  source 1..16: mol_type = other DNA
gaagaagtgcttttgt

SEQ ID NO: 2478 - DNA, 16 bp, synthetic construct
  source 1..16: mol_type = other DNA
agctacctccaaattc

SEQ ID NO: 2479 - DNA, 16 bp, synthetic construct
  source 1..16: mol_type = other DNA
aacaacccagcctcgg

SEQ ID NO: 2480 - DNA, 16 bp, synthetic construct
  source 1..16: mol_type = other DNA
agctgagagttctaca

SEQ ID NO: 2481 - DNA, 16 bp, synthetic construct
  source 1..16: mol_type = other DNA
atcaacctgcacacca

SEQ ID NO: 2482 - DNA, 16 bp, synthetic construct
  source 1..16: mol_type = other DNA
tataactggaaggagg

SEQ ID NO: 2483 - DNA, 16 bp, synthetic construct
  source 1..16: mol_type = other DNA
tcaaatgaggcggcac

SEQ ID NO: 2484 - DNA, 16 bp, synthetic construct
  source 1..16: mol_type = other DNA
ggaatgctcatattaa

SEQ ID NO: 2485 - DNA, 16 bp, synthetic construct
  source 1..16: mol_type = other DNA
tgctgcattaatgcca

SEQ ID NO: 2486 - DNA, 16 bp, synthetic construct
  source 1..16: mol_type = other DNA
taactgagctagacaa

SEQ ID NO: 2487 - DNA, 16 bp, synthetic construct
  source 1..16: mol_type = other DNA
gtacatgccaagcttt

SEQ ID NO: 2488 - DNA, 16 bp, synthetic construct
  source 1..16: mol_type = other DNA
ataggcagtaaagtgc

SEQ ID NO: 2489 - DNA, 16 bp, synthetic construct
  source 1..16: mol_type = other DNA
ctgtcataaaggtggg

SEQ ID NO: 2490 - DNA, 16 bp, synthetic construct
  source 1..16: mol_type = other DNA
tccaagtaattacttc

SEQ ID NO: 2491 - DNA, 16 bp, synthetic construct
  source 1..16: mol_type = other DNA
ctaatttagtcaactt

SEQ ID NO: 2492 - DNA, 16 bp, synthetic construct
  source 1..16: mol_type = other DNA
taagttaccagagcat

SEQ ID NO: 2493 - DNA, 16 bp, synthetic construct
  source 1..16: mol_type = other DNA
gatggtaagtcaaata

SEQ ID NO: 2494 - DNA, 16 bp, synthetic construct
  source 1..16: mol_type = other DNA
ttggccgaggagggcg

SEQ ID NO: 2495 - DNA, 16 bp, synthetic construct
  source 1..16: mol_type = other DNA
tctaaagggctgctct

SEQ ID NO: 2496 - DNA, 16 bp, synthetic construct
  source 1..16: mol_type = other DNA
cgctactgtaggctaa

SEQ ID NO: 2497 - DNA, 16 bp, synthetic construct
  source 1..16: mol_type = other DNA
attgatacaccaatgc

SEQ ID NO: 2498 - DNA, 16 bp, synthetic construct
  source 1..16: mol_type = other DNA
ataaagctttgcagca

SEQ ID NO: 2499 - DNA, 16 bp, synthetic construct
  source 1..16: mol_type = other DNA
taagctgagagttcta

SEQ ID NO: 2500 - DNA, 16 bp, synthetic construct
  source 1..16: mol_type = other DNA
ctataactggaaggag

SEQ ID NO: 2501 - DNA, 16 bp, synthetic construct
  source 1..16: mol_type = other DNA
tgtacaaatttatgcc

SEQ ID NO: 2502 - DNA, 16 bp, synthetic construct
  source 1..16: mol_type = other DNA
gaagccactgtgacga

SEQ ID NO: 2503 - DNA, 16 bp, synthetic construct
  source 1..16: mol_type = other DNA
caattcacatatgtga

SEQ ID NO: 2504 - DNA, 16 bp, synthetic construct
  source 1..16: mol_type = other DNA
aggtatgtcatacttc

SEQ ID NO: 2505 - DNA, 16 bp, synthetic construct
  source 1..16: mol_type = other DNA
gataaaatagggtgca

SEQ ID NO: 2506 - DNA, 16 bp, synthetic construct
  source 1..16: mol_type = other DNA
atttgctgcattaatg

SEQ ID NO: 2507 - DNA, 16 bp, synthetic construct
  source 1..16: mol_type = other DNA
attatgtgattgagtt

SEQ ID NO: 2508 - DNA, 16 bp, synthetic construct
  source 1..16: mol_type = other DNA
gcccatcccctaagtt

SEQ ID NO: 2509 - DNA, 16 bp, synthetic construct
  source 1..16: mol_type = other DNA
tgccccgaattatttc

SEQ ID NO: 2510 - DNA, 16 bp, synthetic construct
  source 1..16: mol_type = other DNA
gcttacgacaggtcat

SEQ ID NO: 2511 - DNA, 16 bp, synthetic construct
  source 1..16: mol_type = other DNA
cataataatagctcta

SEQ ID NO: 2512 - DNA, 16 bp, synthetic construct
  source 1..16: mol_type = other DNA
tgactaatgcaagatt

SEQ ID NO: 2513 - DNA, 16 bp, synthetic construct
  source 1..16: mol_type = other DNA
ttaagtactgtgagac

SEQ ID NO: 2514 - DNA, 16 bp, synthetic construct
  source 1..16: mol_type = other DNA
gttcaactgaacctct

SEQ ID NO: 2515 - DNA, 16 bp, synthetic construct
  source 1..16: mol_type = other DNA
tgagagtataaatggc

SEQ ID NO: 2516 - DNA, 16 bp, synthetic construct
  source 1..16: mol_type = other DNA
tattctcttgacaatg

SEQ ID NO: 2517 - DNA, 16 bp, synthetic construct
  source 1..16: mol_type = other DNA
ttctatgcaagccttc

SEQ ID NO: 2518 - DNA, 16 bp, synthetic construct
  source 1..16: mol_type = other DNA
ttatgaagttagtata

SEQ ID NO: 2519 - DNA, 16 bp, synthetic construct
  source 1..16: mol_type = other DNA
gacactaatttagtca

SEQ ID NO: 2520 - DNA, 16 bp, synthetic construct
  source 1..16: mol_type = other DNA
gatagtccatgcaaaa

SEQ ID NO: 2521 - DNA, 16 bp, synthetic construct
  source 1..16: mol_type = other DNA
gatttttggtgaaccc

SEQ ID NO: 2522 - DNA, 16 bp, synthetic construct
  source 1..16: mol_type = other DNA
attgaattcactatct

SEQ ID NO: 2523 - DNA, 16 bp, synthetic construct
  source 1..16: mol_type = other DNA
gcaaggatacctgaaa

SEQ ID NO: 2524 - DNA, 16 bp, synthetic construct
  source 1..16: mol_type = other DNA
ctgctactctaggaga

SEQ ID NO: 2525 - DNA, 16 bp, synthetic construct
  source 1..16: mol_type = other DNA
aattgatacaccaatg

SEQ ID NO: 2526 - DNA, 16 bp, synthetic construct
  source 1..16: mol_type = other DNA
tatcaacctgcacacc

SEQ ID NO: 2527 - DNA, 16 bp, synthetic construct
  source 1..16: mol_type = other DNA
attttactgggatact

SEQ ID NO: 2528 - DNA, 16 bp, synthetic construct
  source 1..16: mol_type = other DNA
ttgcagaaattcacct

SEQ ID NO: 2529 - DNA, 16 bp, synthetic construct
  source 1..16: mol_type = other DNA
agagcataagttacca

SEQ ID NO: 2530 - DNA, 16 bp, synthetic construct
  source 1..16: mol_type = other DNA
agacagttgagtagtg

SEQ ID NO: 2531 - DNA, 16 bp, synthetic construct
  source 1..16: mol_type = other DNA
aaactaggaagtgatc

SEQ ID NO: 2532 - DNA, 16 bp, synthetic construct
  source 1..16: mol_type = other DNA
tttttgaaccgtattc

SEQ ID NO: 2533 - DNA, 16 bp, synthetic construct
  source 1..16: mol_type = other DNA
cagcaaagtttgggca

SEQ ID NO: 2534 - DNA, 16 bp, synthetic construct
  source 1..16: mol_type = other DNA
gattacagcatcaaga

SEQ ID NO: 2535 - DNA, 16 bp, synthetic construct
  source 1..16: mol_type = other DNA
tagaactgtgttgctt

SEQ ID NO: 2536 - DNA, 16 bp, synthetic construct
  source 1..16: mol_type = other DNA
tgtttatgtaagcaca

SEQ ID NO: 2537 - DNA, 16 bp, synthetic construct
  source 1..16: mol_type = other DNA
gaacactgtcataaag

SEQ ID NO: 2538 - DNA, 16 bp, synthetic construct
  source 1..16: mol_type = other DNA
atcacaagtaaggtaa

SEQ ID NO: 2539 - DNA, 16 bp, synthetic construct
  source 1..16: mol_type = other DNA
ccaaccaaacttccag

SEQ ID NO: 2540 - DNA, 16 bp, synthetic construct
  source 1..16: mol_type = other DNA
attgtaatcttgaggc

SEQ ID NO: 2541 - DNA, 16 bp, synthetic construct
  source 1..16: mol_type = other DNA
ctcctggtacatgcca

SEQ ID NO: 2542 - DNA, 16 bp, synthetic construct
  source 1..16: mol_type = other DNA
taatggtaaactgtat

SEQ ID NO: 2543 - DNA, 16 bp, synthetic construct
  source 1..16: mol_type = other DNA
cctagttgcaatgaga

SEQ ID NO: 2544 - DNA, 16 bp, synthetic construct
  source 1..16: mol_type = other DNA
gtggtaacggtgatca

SEQ ID NO: 2545 - DNA, 16 bp, synthetic construct
  source 1..16: mol_type = other DNA
gggaatgctcatatta

SEQ ID NO: 2546 - DNA, 16 bp, synthetic construct
  source 1..16: mol_type = other DNA
tgtcagagactctgtg

SEQ ID NO: 2547 - DNA, 16 bp, synthetic construct
  source 1..16: mol_type = other DNA
cgtcctaggaaacaaa

SEQ ID NO: 2548 - DNA, 16 bp, synthetic construct
  source 1..16: mol_type = other DNA
ctacatgacctgggtc

SEQ ID NO: 2549 - DNA, 16 bp, synthetic construct
  source 1..16: mol_type = other DNA
ggagtacttcacaatt

SEQ ID NO: 2550 - DNA, 16 bp, synthetic construct
  source 1..16: mol_type = other DNA
gattgcataagagcca

SEQ ID NO: 2551 - DNA, 16 bp, synthetic construct
  source 1..16: mol_type = other DNA
tcagtatcccctcaaa

SEQ ID NO: 2552 - DNA, 16 bp, synthetic construct
  source 1..16: mol_type = other DNA
ggaccaatataatcca

SEQ ID NO: 2553 - DNA, 16 bp, synthetic construct
  source 1..16: mol_type = other DNA
acatccaagtaattac

SEQ ID NO: 2554 - DNA, 16 bp, synthetic construct
  source 1..16: mol_type = other DNA
tgccagattgcacaaa

SEQ ID NO: 2555 - DNA, 16 bp, synthetic construct
  source 1..16: mol_type = other DNA
aacttcatagtggact

SEQ ID NO: 2556 - DNA, 16 bp, synthetic construct
  source 1..16: mol_type = other DNA
gcaagccaacagagag

SEQ ID NO: 2557 - DNA, 16 bp, synthetic construct
  source 1..16: mol_type = other DNA
tttagtcaggtagagt

SEQ ID NO: 2558 - DNA, 16 bp, synthetic construct
  source 1..16: mol_type = other DNA
tgtatagctgcatttc

SEQ ID NO: 2559 - DNA, 16 bp, synthetic construct
  source 1..16: mol_type = other DNA
tttcgctactgtaggc

SEQ ID NO: 2560 - DNA, 16 bp, synthetic construct
  source 1..16: mol_type = other DNA
cagccttagagtgaat

SEQ ID NO: 2561 - DNA, 16 bp, synthetic construct
  source 1..16: mol_type = other DNA
gagatttgaaggttag

SEQ ID NO: 2562 - DNA, 16 bp, synthetic construct
  source 1..16: mol_type = other DNA
agtaatcagttttcct

SEQ ID NO: 2563 - DNA, 16 bp, synthetic construct
  source 1..16: mol_type = other DNA
acttcagagttataca

SEQ ID NO: 2564 - DNA, 16 bp, synthetic construct
  source 1..16: mol_type = other DNA
cattcggctaggcgcg

SEQ ID NO: 2565 - DNA, 16 bp, synthetic construct
  source 1..16: mol_type = other DNA
caagctacctccaaat

SEQ ID NO: 2566 - DNA, 16 bp, synthetic construct
  source 1..16: mol_type = other DNA
cattctgtgttcttgt

SEQ ID NO: 2567 - DNA, 16 bp, synthetic construct
  source 1..16: mol_type = other DNA
gtagatggtaagtcaa

SEQ ID NO: 2568 - DNA, 16 bp, synthetic construct
  source 1..16: mol_type = other DNA
aaattgtctaaacatc

SEQ ID NO: 2569 - DNA, 16 bp, synthetic construct
  source 1..16: mol_type = other DNA
actggatggatttctc

SEQ ID NO: 2570 - DNA, 16 bp, synthetic construct
  source 1..16: mol_type = other DNA
atggtaagccccatgc

SEQ ID NO: 2571 - DNA, 16 bp, synthetic construct
  source 1..16: mol_type = other DNA
gtaataggcagtaaag

SEQ ID NO: 2572 - DNA, 16 bp, synthetic construct
  source 1..16: mol_type = other DNA
aagagtcagtatcctc

SEQ ID NO: 2573 - DNA, 16 bp, synthetic construct
  source 1..16: mol_type = other DNA
attctacactaatatt

SEQ ID NO: 2574 - DNA, 16 bp, synthetic construct
  source 1..16: mol_type = other DNA
ataactgagctagaca

SEQ ID NO: 2575 - DNA, 16 bp, synthetic construct
  source 1..16: mol_type = other DNA
gttattctcttgacaa

SEQ ID NO: 2576 - DNA, 16 bp, synthetic construct
  source 1..16: mol_type = other DNA
aacttttagtcaggta

SEQ ID NO: 2577 - DNA, 16 bp, synthetic construct
  source 1..16: mol_type = other DNA
cccaaccaaacttcca

SEQ ID NO: 2578 - DNA, 16 bp, synthetic construct
  source 1..16: mol_type = other DNA
atgggatgaggtaagg

SEQ ID NO: 2579 - DNA, 16 bp, synthetic construct
  source 1..16: mol_type = other DNA
acaatcaggagttgca

SEQ ID NO: 2580 - DNA, 16 bp, synthetic construct
  source 1..16: mol_type = other DNA
ttagcttaaactccaa

SEQ ID NO: 2581 - DNA, 16 bp, synthetic construct
  source 1..16: mol_type = other DNA
cttgcagaaattcacc

SEQ ID NO: 2582 - DNA, 16 bp, synthetic construct
  source 1..16: mol_type = other DNA
catctagaattaaggg

SEQ ID NO: 2583 - DNA, 16 bp, synthetic construct
  source 1..16: mol_type = other DNA
ctttgagactcttgtt

SEQ ID NO: 2584 - DNA, 16 bp, synthetic construct
  source 1..16: mol_type = other DNA
aggcttatgaagttag

SEQ ID NO: 2585 - DNA, 16 bp, synthetic construct
  source 1..16: mol_type = other DNA
gttgactaatgcaaga

SEQ ID NO: 2586 - DNA, 16 bp, synthetic construct
  source 1..16: mol_type = other DNA
aaattgatacaccaat

SEQ ID NO: 2587 - DNA, 16 bp, synthetic construct
  source 1..16: mol_type = other DNA
tgcttacgacaggtca

SEQ ID NO: 2588 - DNA, 16 bp, synthetic construct
  source 1..16: mol_type = other DNA
atccattctatgcaag

SEQ ID NO: 2589 - DNA, 16 bp, synthetic construct
  source 1..16: mol_type = other DNA
aaacttgatctcttag

SEQ ID NO: 2590 - DNA, 16 bp, synthetic construct
  source 1..16: mol_type = other DNA
ctaaaattgtctaaac

SEQ ID NO: 2591 - DNA, 16 bp, synthetic construct
  source 1..16: mol_type = other DNA
ggtggtaacggtgatc

SEQ ID NO: 2592 - DNA, 16 bp, synthetic construct
  source 1..16: mol_type = other DNA
tgattacagcatcaag

SEQ ID NO: 2593 - DNA, 16 bp, synthetic construct
  source 1..16: mol_type = other DNA
ggatagtccatgcaaa

SEQ ID NO: 2594 - DNA, 16 bp, synthetic construct
  source 1..16: mol_type = other DNA
tcttataagactataa

SEQ ID NO: 2595 - DNA, 16 bp, synthetic construct
  source 1..16: mol_type = other DNA
agctaagagacacttc

SEQ ID NO: 2596 - DNA, 16 bp, synthetic construct
  source 1..16: mol_type = other DNA
gaacagttcaactgaa

SEQ ID NO: 2597 - DNA, 16 bp, synthetic construct
  source 1..16: mol_type = other DNA
tattatcaggactgaa

SEQ ID NO: 2598 - DNA, 16 bp, synthetic construct
  source 1..16: mol_type = other DNA
taatcacaagtaaggt

SEQ ID NO: 2599 - DNA, 16 bp, synthetic construct
  source 1..16: mol_type = other DNA
gggaccaatataatcc

SEQ ID NO: 2600 - DNA, 16 bp, synthetic construct
  source 1..16: mol_type = other DNA
acaacccttaacaaac

SEQ ID NO: 2601 - DNA, 16 bp, synthetic construct
  source 1..16: mol_type = other DNA
ccaactatgtaatagg

SEQ ID NO: 2602 - DNA, 16 bp, synthetic construct
  source 1..16: mol_type = other DNA
tattaagacagttgag

SEQ ID NO: 2603 - DNA, 16 bp, synthetic construct
  source 1..16: mol_type = other DNA
ttctcaaggagtactt

SEQ ID NO: 2604 - DNA, 16 bp, synthetic construct
  source 1..16: mol_type = other DNA
tatatgaggtctgtat

SEQ ID NO: 2605 - DNA, 16 bp, synthetic construct
  source 1..16: mol_type = other DNA
ccaacccaagctacct

SEQ ID NO: 2606 - DNA, 16 bp, synthetic construct
  source 1..16: mol_type = other DNA
agtcagtatcccctca

SEQ ID NO: 2607 - DNA, 16 bp, synthetic construct
  source 1..16: mol_type = other DNA
ctgccagattgcacaa

SEQ ID NO: 2608 - DNA, 16 bp, synthetic construct
  source 1..16: mol_type = other DNA
attacagccttagagt

SEQ ID NO: 2609 - DNA, 16 bp, synthetic construct
  source 1..16: mol_type = other DNA
ctatcaacctgcacac

SEQ ID NO: 2610 - DNA, 16 bp, synthetic construct
  source 1..16: mol_type = other DNA
gcctagttgcaatgag

SEQ ID NO: 2611 - DNA, 16 bp, synthetic construct
  source 1..16: mol_type = other DNA
taacattcggctaggc

SEQ ID NO: 2612 - DNA, 16 bp, synthetic construct
  source 1..16: mol_type = other DNA
ctgcgcacatatttta

SEQ ID NO: 2613 - DNA, 16 bp, synthetic construct
  source 1..16: mol_type = other DNA
tagagagcataagtta

SEQ ID NO: 2614 - DNA, 16 bp, synthetic construct
  source 1..16: mol_type = other DNA
tgattgaattcactat

SEQ ID NO: 2615 - DNA, 16 bp, synthetic construct
  source 1..16: mol_type = other DNA
ccaaaaatcagccact

SEQ ID NO: 2616 - DNA, 16 bp, synthetic construct
  source 1..16: mol_type = other DNA
gcagctaaaatccaat

SEQ ID NO: 2617 - DNA, 16 bp, synthetic construct
  source 1..16: mol_type = other DNA
aacctttgttgcctgg

SEQ ID NO: 2618 - DNA, 16 bp, synthetic construct
  source 1..16: mol_type = other DNA
gaggtatgtcatactt

SEQ ID NO: 2619 - DNA, 16 bp, synthetic construct
  source 1..16: mol_type = other DNA
tattccaggatttgct

SEQ ID NO: 2620 - DNA, 16 bp, synthetic construct
  source 1..16: mol_type = other DNA
taagtagatggtaagt

SEQ ID NO: 2621 - DNA, 16 bp, synthetic construct
  source 1..16: mol_type = other DNA
ggccaagggaacactg

SEQ ID NO: 2622 - DNA, 16 bp, synthetic construct
  source 1..16: mol_type = other DNA
atgtttatgtaagcac

SEQ ID NO: 2623 - DNA, 16 bp, synthetic construct
  source 1..16: mol_type = other DNA
atcccgttcttgccca

SEQ ID NO: 2624 - DNA, 16 bp, synthetic construct
  source 1..16: mol_type = other DNA
ccttaccttgtgcttg

SEQ ID NO: 2625 - DNA, 16 bp, synthetic construct
  source 1..16: mol_type = other DNA
atctcacaagggaaat

SEQ ID NO: 2626 - DNA, 16 bp, synthetic construct
  source 1..16: mol_type = other DNA
ctagtggtaatggtaa

SEQ ID NO: 2627 - DNA, 16 bp, synthetic construct
  source 1..16: mol_type = other DNA
ttggtatggtaagccc

SEQ ID NO: 2628 - DNA, 16 bp, synthetic construct
  source 1..16: mol_type = other DNA
tataactgagctagac

SEQ ID NO: 2629 - DNA, 16 bp, synthetic construct
  source 1..16: mol_type = other DNA
atatacatccaagtaa

SEQ ID NO: 2630 - DNA, 16 bp, synthetic construct
  source 1..16: mol_type = other DNA
cactggatggatttct

SEQ ID NO: 2631 - DNA, 16 bp, synthetic construct
  source 1..16: mol_type = other DNA
agtttagattgcataa

SEQ ID NO: 2632 - DNA, 16 bp, synthetic construct
  source 1..16: mol_type = other DNA
tagtcttcagcaaagt

SEQ ID NO: 2633 - DNA, 16 bp, synthetic construct
  source 1..16: mol_type = other DNA
atagcaagccaacaga

SEQ ID NO: 2634 - DNA, 16 bp, synthetic construct
  source 1..16: mol_type = other DNA
attattatgtgattga

SEQ ID NO: 2635 - DNA, 16 bp, synthetic construct
  source 1..16: mol_type = other DNA
ctagattctacactaa

SEQ ID NO: 2636 - DNA, 16 bp, synthetic construct
  source 1..16: mol_type = other DNA
tagtttggtgggcatg

SEQ ID NO: 2637 - DNA, 16 bp, synthetic construct
  source 1..16: mol_type = other DNA
taacttcatagtggac

SEQ ID NO: 2638 - DNA, 16 bp, synthetic construct
  source 1..16: mol_type = other DNA
ctccataataatagct

SEQ ID NO: 2639 - DNA, 16 bp, synthetic construct
  source 1..16: mol_type = other DNA
gtaagctgagagttct

SEQ ID NO: 2640 - DNA, 16 bp, synthetic construct
  source 1..16: mol_type = other DNA
tacgacttccttctaa

SEQ ID NO: 2641 - DNA, 16 bp, synthetic construct
  source 1..16: mol_type = other DNA
ccataaagctggattg

SEQ ID NO: 2642 - DNA, 16 bp, synthetic construct
  source 1..16: mol_type = other DNA
agaggcaaggatacct

SEQ ID NO: 2643 - DNA, 16 bp, synthetic construct
  source 1..16: mol_type = other DNA
agtaccaagacactaa

SEQ ID NO: 2644 - DNA, 16 bp, synthetic construct
  source 1..16: mol_type = other DNA
actacatgacctgggt

SEQ ID NO: 2645 - DNA, 16 bp, synthetic construct
  source 1..16: mol_type = other DNA
acttgaattctgtgtc

SEQ ID NO: 2646 - DNA, 16 bp, synthetic construct
  source 1..16: mol_type = other DNA
gaccatgctgctactc

SEQ ID NO: 2647 - DNA, 16 bp, synthetic construct
  source 1..16: mol_type = other DNA
cagcattgtaatcttg

SEQ ID NO: 2648 - DNA, 16 bp, synthetic construct
  source 1..16: mol_type = other DNA
gccagggaatgctcat

SEQ ID NO: 2649 - DNA, 16 bp, synthetic construct
  source 1..16: mol_type = other DNA
gtaagagtcagtatcc

SEQ ID NO: 2650 - DNA, 16 bp, synthetic construct
  source 1..16: mol_type = other DNA
tatttcgctactgtag

SEQ ID NO: 2651 - DNA, 16 bp, synthetic construct
  source 1..16: mol_type = other DNA
agagagtaatcagttt

SEQ ID NO: 2652 - DNA, 16 bp, synthetic construct
  source 1..16: mol_type = other DNA
tgtaagagtcagtatc

SEQ ID NO: 2653 - DNA, 16 bp, synthetic construct
  source 1..16: mol_type = other DNA
agtatgtttatgtaag

SEQ ID NO: 2654 - DNA, 16 bp, synthetic construct
  source 1..16: mol_type = other DNA
gactttgagactcttg

SEQ ID NO: 2655 - DNA, 16 bp, synthetic construct
  source 1..16: mol_type = other DNA
gatcctatatacatcc

SEQ ID NO: 2656 - DNA, 16 bp, synthetic construct
  source 1..16: mol_type = other DNA
tgcaacttttagtcag

SEQ ID NO: 2657 - DNA, 16 bp, synthetic construct
  source 1..16: mol_type = other DNA
atcccaaccaaacttc

SEQ ID NO: 2658 - DNA, 16 bp, synthetic construct
  source 1..16: mol_type = other DNA
atatgggatgaggtaa

SEQ ID NO: 2659 - DNA, 16 bp, synthetic construct
  source 1..16: mol_type = other DNA
ttccgtctcacaatct

SEQ ID NO: 2660 - DNA, 16 bp, synthetic construct
  source 1..16: mol_type = other DNA
tcagaacagttcaact

SEQ ID NO: 2661 - DNA, 16 bp, synthetic construct
  source 1..16: mol_type = other DNA
atcttataagactata

SEQ ID NO: 2662 - DNA, 16 bp, synthetic construct
  source 1..16: mol_type = other DNA
gaatccattctatgca

SEQ ID NO: 2663 - DNA, 16 bp, synthetic construct
  source 1..16: mol_type = other DNA
agttattctcttgaca

SEQ ID NO: 2664 - DNA, 16 bp, synthetic construct
  source 1..16: mol_type = other DNA
gacataacttcatagt

SEQ ID NO: 2665 - DNA, 16 bp, synthetic construct
  source 1..16: mol_type = other DNA
gctccataataatagc

SEQ ID NO: 2666 - DNA, 16 bp, synthetic construct
  source 1..16: mol_type = other DNA
accttaccttgtgctt

SEQ ID NO: 2667 - DNA, 16 bp, synthetic construct
  source 1..16: mol_type = other DNA
tagtaccaagacacta

SEQ ID NO: 2668 - DNA, 16 bp, synthetic construct
  source 1..16: mol_type = other DNA
aaggcttatgaagtta

SEQ ID NO: 2669 - DNA, 16 bp, synthetic construct
  source 1..16: mol_type = other DNA
tgaaattgatacacca

SEQ ID NO: 2670 - DNA, 16 bp, synthetic construct
  source 1..16: mol_type = other DNA
cggcctattcttctgt

SEQ ID NO: 2671 - DNA, 16 bp, synthetic construct
  source 1..16: mol_type = other DNA
attaacattcggctag

SEQ ID NO: 2672 - DNA, 16 bp, synthetic construct
  source 1..16: mol_type = other DNA
aatatcagccatctag

SEQ ID NO: 2673 - DNA, 16 bp, synthetic construct
  source 1..16: mol_type = other DNA
tgccaaaccaatgttt

SEQ ID NO: 2674 - DNA, 16 bp, synthetic construct
  source 1..16: mol_type = other DNA
gacaacccttaacaaa

SEQ ID NO: 2675 - DNA, 16 bp, synthetic construct
  source 1..16: mol_type = other DNA
ataagtagatggtaag

SEQ ID NO: 2676 - DNA, 16 bp, synthetic construct
  source 1..16: mol_type = other DNA
tcaaaacctttgttgc

SEQ ID NO: 2677 - DNA, 16 bp, synthetic construct
  source 1..16: mol_type = other DNA
tgccagggaatgctca

SEQ ID NO: 2678 - DNA, 16 bp, synthetic construct
  source 1..16: mol_type = other DNA
atgtatgaggtctccg

SEQ ID NO: 2679 - DNA, 16 bp, synthetic construct
  source 1..16: mol_type = other DNA
accaagagggttttta

SEQ ID NO: 2680 - DNA, 16 bp, synthetic construct
  source 1..16: mol_type = other DNA
atttttaatacgactt

SEQ ID NO: 2681 - DNA, 16 bp, synthetic construct
  source 1..16: mol_type = other DNA
tgtaagctgagagttc

SEQ ID NO: 2682 - DNA, 16 bp, synthetic construct
  source 1..16: mol_type = other DNA
cccaacccaagctacc

SEQ ID NO: 2683 - DNA, 16 bp, synthetic construct
  source 1..16: mol_type = other DNA
cactttggtattgttg

SEQ ID NO: 2684 - DNA, 16 bp, synthetic construct
  source 1..16: mol_type = other DNA
gactgttgagctcaaa

SEQ ID NO: 2685 - DNA, 16 bp, synthetic construct
  source 1..16: mol_type = other DNA
agtagagagcataagt

SEQ ID NO: 2686 - DNA, 16 bp, synthetic construct
  source 1..16: mol_type = other DNA
gactacattaacacca

SEQ ID NO: 2687 - DNA, 16 bp, synthetic construct
  source 1..16: mol_type = other DNA
aaactagtggtaatgg

SEQ ID NO: 2688 - DNA, 16 bp, synthetic construct
  source 1..16: mol_type = other DNA
ctgattacagcatcaa

SEQ ID NO: 2689 - DNA, 16 bp, synthetic construct
  source 1..16: mol_type = other DNA
cttgagagtgattgcc

SEQ ID NO: 2690 - DNA, 16 bp, synthetic construct
  source 1..16: mol_type = other DNA
aggatagtccatgcaa

SEQ ID NO: 2691 - DNA, 16 bp, synthetic construct
  source 1..16: mol_type = other DNA
gatacaaatttattgg

SEQ ID NO: 2692 - DNA, 16 bp, synthetic construct
  source 1..16: mol_type = other DNA
cactgccagattgcac

SEQ ID NO: 2693 - DNA, 16 bp, synthetic construct
  source 1..16: mol_type = other DNA
ctttctatcaacctgc

SEQ ID NO: 2694 - DNA, 16 bp, synthetic construct
  source 1..16: mol_type = other DNA
agtatgacaactggag

SEQ ID NO: 2695 - DNA, 16 bp, synthetic construct
  source 1..16: mol_type = other DNA
cgtaaccatgcattaa

SEQ ID NO: 2696 - DNA, 16 bp, synthetic construct
  source 1..16: mol_type = other DNA
ccactggatggatttc

SEQ ID NO: 2697 - DNA, 16 bp, synthetic construct
  source 1..16: mol_type = other DNA
gttagcagctaaaatc

SEQ ID NO: 2698 - DNA, 16 bp, synthetic construct
  source 1..16: mol_type = other DNA
aaagtcagtatcccct

SEQ ID NO: 2699 - DNA, 16 bp, synthetic construct
  source 1..16: mol_type = other DNA
tcaactaaacatgaca

SEQ ID NO: 2700 - DNA, 16 bp, synthetic construct
  source 1..16: mol_type = other DNA
gaatcatgattgaatt

SEQ ID NO: 2701 - DNA, 16 bp, synthetic construct
  source 1..16: mol_type = other DNA
agatcccgttcttgcc

SEQ ID NO: 2702 - DNA, 16 bp, synthetic construct
  source 1..16: mol_type = other DNA
cgcaacagtttagatt

SEQ ID NO: 2703 - DNA, 16 bp, synthetic construct
  source 1..16: mol_type = other DNA
ttagcaagctaagaga

SEQ ID NO: 2704 - DNA, 16 bp, synthetic construct
  source 1..16: mol_type = other DNA
gggtggtaacggtgat

SEQ ID NO: 2705 - DNA, 16 bp, synthetic construct
  source 1..16: mol_type = other DNA
caaggaaaagcctgac

SEQ ID NO: 2706 - DNA, 16 bp, synthetic construct
  source 1..16: mol_type = other DNA
ctggtttcataaccta

SEQ ID NO: 2707 - DNA, 16 bp, synthetic construct
  source 1..16: mol_type = other DNA
ttatatgaggtctgta

SEQ ID NO: 2708 - DNA, 16 bp, synthetic construct
  source 1..16: mol_type = other DNA
ttgggaccaatataat

SEQ ID NO: 2709 - DNA, 16 bp, synthetic construct
  source 1..16: mol_type = other DNA
tgtgagaaggcggtat

SEQ ID NO: 2710 - DNA, 16 bp, synthetic construct
  source 1..16: mol_type = other DNA
tgtatttcgctactgt

SEQ ID NO: 2711 - DNA, 16 bp, synthetic construct
  source 1..16: mol_type = other DNA
aatagtcttcagcaaa

SEQ ID NO: 2712 - DNA, 16 bp, synthetic construct
  source 1..16: mol_type = other DNA
aagatacccaggttgc

SEQ ID NO: 2713 - DNA, 16 bp, synthetic construct
  source 1..16: mol_type = other DNA
gctttagcttaaactc

SEQ ID NO: 2714 - DNA, 16 bp, synthetic construct
  source 1..16: mol_type = other DNA
gtccacttgaattctg

SEQ ID NO: 2715 - DNA, 16 bp, synthetic construct
  source 1..16: mol_type = other DNA
tgagttacattacagc

SEQ ID NO: 2716 - DNA, 16 bp, synthetic construct
  source 1..16: mol_type = other DNA
gtgttagctttaattt

SEQ ID NO: 2717 - DNA, 16 bp, synthetic construct
  source 1..16: mol_type = other DNA
gaaacttgatctctta

SEQ ID NO: 2718 - DNA, 16 bp, synthetic construct
  source 1..16: mol_type = other DNA
gccctagattctacac

SEQ ID NO: 2719 - DNA, 16 bp, synthetic construct
  source 1..16: mol_type = other DNA
ttccataaagctggat

SEQ ID NO: 2720 - DNA, 16 bp, synthetic construct
  source 1..16: mol_type = other DNA
tacaacctggtttcat

SEQ ID NO: 2721 - DNA, 16 bp, synthetic construct
  source 1..16: mol_type = other DNA
agggagaccatgctgc

SEQ ID NO: 2722 - DNA, 16 bp, synthetic construct
  source 1..16: mol_type = other DNA
accaactatgtaatag

SEQ ID NO: 2723 - DNA, 16 bp, synthetic construct
  source 1..16: mol_type = other DNA
cagattattatgtgat

SEQ ID NO: 2724 - DNA, 16 bp, synthetic construct
  source 1..16: mol_type = other DNA
gtaactgtattaagac

SEQ ID NO: 2725 - DNA, 16 bp, synthetic construct
  source 1..16: mol_type = other DNA
ttcttgcagaaattca

SEQ ID NO: 2726 - DNA, 16 bp, synthetic construct
  source 1..16: mol_type = other DNA
aatagcaagccaacag

SEQ ID NO: 2727 - DNA, 16 bp, synthetic construct
  source 1..16: mol_type = other DNA
agtaatcacaagtaag

SEQ ID NO: 2728 - DNA, 16 bp, synthetic construct
  source 1..16: mol_type = other DNA
atctatcagacttctt

SEQ ID NO: 2729 - DNA, 16 bp, synthetic construct
  source 1..16: mol_type = other DNA
cagggtggtaacggtg

SEQ ID NO: 2730 - DNA, 16 bp, synthetic construct
  source 1..16: mol_type = other DNA
acccattctaacttga

SEQ ID NO: 2731 - DNA, 16 bp, synthetic construct
  source 1..16: mol_type = other DNA
taccaagagggttttt

SEQ ID NO: 2732 - DNA, 16 bp, synthetic construct
  source 1..16: mol_type = other DNA
ctgtaagagtcagtat

SEQ ID NO: 2733 - DNA, 16 bp, synthetic construct
  source 1..16: mol_type = other DNA
ttgacataacttcata

SEQ ID NO: 2734 - DNA, 16 bp, synthetic construct
  source 1..16: mol_type = other DNA
tgttagctaagggaga

SEQ ID NO: 2735 - DNA, 16 bp, synthetic construct
  source 1..16: mol_type = other DNA
cagcatattcatttgg

SEQ ID NO: 2736 - DNA, 16 bp, synthetic construct
  source 1..16: mol_type = other DNA
tgttaggacccagtct

SEQ ID NO: 2737 - DNA, 16 bp, synthetic construct
  source 1..16: mol_type = other DNA
ttcttgagagtgattg

SEQ ID NO: 2738 - DNA, 16 bp, synthetic construct
  source 1..16: mol_type = other DNA
gcccttaagtcatttt

SEQ ID NO: 2739 - DNA, 16 bp, synthetic construct
  source 1..16: mol_type = other DNA
attacaacctggtttc

SEQ ID NO: 2740 - DNA, 16 bp, synthetic construct
  source 1..16: mol_type = other DNA
cattagcaagctaaga

SEQ ID NO: 2741 - DNA, 16 bp, synthetic construct
  source 1..16: mol_type = other DNA
cactatcagaacagtt

SEQ ID NO: 2742 - DNA, 16 bp, synthetic construct
  source 1..16: mol_type = other DNA
cttgaatagcaagcca

SEQ ID NO: 2743 - DNA, 16 bp, synthetic construct
  source 1..16: mol_type = other DNA
ttagtaccaagacact

SEQ ID NO: 2744 - DNA, 16 bp, synthetic construct
  source 1..16: mol_type = other DNA
aagacattctagcctg

SEQ ID NO: 2745 - DNA, 16 bp, synthetic construct
  source 1..16: mol_type = other DNA
atggcttaattttcgg

SEQ ID NO: 2746 - DNA, 16 bp, synthetic construct
  source 1..16: mol_type = other DNA
agttattagaagtcag

SEQ ID NO: 2747 - DNA, 16 bp, synthetic construct
  source 1..16: mol_type = other DNA
atagtaatcacaagta

SEQ ID NO: 2748 - DNA, 16 bp, synthetic construct
  source 1..16: mol_type = other DNA
tgtgttagctttaatt

SEQ ID NO: 2749 - DNA, 16 bp, synthetic construct
  source 1..16: mol_type = other DNA
gagtatgacaactgga

SEQ ID NO: 2750 - DNA, 16 bp, synthetic construct
  source 1..16: mol_type = other DNA
ttggtaagtattccat

SEQ ID NO: 2751 - DNA, 16 bp, synthetic construct
  source 1..16: mol_type = other DNA
taagaggcatgaaagg

SEQ ID NO: 2752 - DNA, 16 bp, synthetic construct
  source 1..16: mol_type = other DNA
agttttgggaccaata

SEQ ID NO: 2753 - DNA, 16 bp, synthetic construct
  source 1..16: mol_type = other DNA
gagttattctcttgac

SEQ ID NO: 2754 - DNA, 16 bp, synthetic construct
  source 1..16: mol_type = other DNA
aattaacattcggcta

SEQ ID NO: 2755 - DNA, 16 bp, synthetic construct
  source 1..16: mol_type = other DNA
aatcccaaccaaactt

SEQ ID NO: 2756 - DNA, 16 bp, synthetic construct
  source 1..16: mol_type = other DNA
caagagacaccaccag

SEQ ID NO: 2757 - DNA, 16 bp, synthetic construct
  source 1..16: mol_type = other DNA
taaactagtggtaatg

SEQ ID NO: 2758 - DNA, 16 bp, synthetic construct
  source 1..16: mol_type = other DNA
cctttgtatttcgcta

SEQ ID NO: 2759 - DNA, 16 bp, synthetic construct
  source 1..16: mol_type = other DNA
ttcatagggagaccat

SEQ ID NO: 2760 - DNA, 16 bp, synthetic construct
  source 1..16: mol_type = other DNA
gtgtaagctgagagtt

SEQ ID NO: 2761 - DNA, 16 bp, synthetic construct
  source 1..16: mol_type = other DNA
acttaccaatatggga

SEQ ID NO: 2762 - DNA, 16 bp, synthetic construct
  source 1..16: mol_type = other DNA
atagctaagtatactt

SEQ ID NO: 2763 - DNA, 16 bp, synthetic construct
  source 1..16: mol_type = other DNA
atactgaaattgatac

SEQ ID NO: 2764 - DNA, 16 bp, synthetic construct
  source 1..16: mol_type = other DNA
gctaatgtatgaggtc

SEQ ID NO: 2765 - DNA, 16 bp, synthetic construct
  source 1..16: mol_type = other DNA
agaccaagtagcttac

SEQ ID NO: 2766 - DNA, 16 bp, synthetic construct
  source 1..16: mol_type = other DNA
gatctgagttacatta

SEQ ID NO: 2767 - DNA, 16 bp, synthetic construct
  source 1..16: mol_type = other DNA
gaaatcttgtgtaact

SEQ ID NO: 2768 - DNA, 16 bp, synthetic construct
  source 1..16: mol_type = other DNA
actgacaacccttaac

SEQ ID NO: 2769 - DNA, 16 bp, synthetic construct
  source 1..16: mol_type = other DNA
gaatagtcttcagcaa

SEQ ID NO: 2770 - DNA, 16 bp, synthetic construct
  source 1..16: mol_type = other DNA
ttctacagaagactac

SEQ ID NO: 2771 - DNA, 16 bp, synthetic construct
  source 1..16: mol_type = other DNA
actaaccaattatatg

SEQ ID NO: 2772 - DNA, 16 bp, synthetic construct
  source 1..16: mol_type = other DNA
tgctccataataatag

SEQ ID NO: 2773 - DNA, 16 bp, synthetic construct
  source 1..16: mol_type = other DNA
aatgtatcttataaga

SEQ ID NO: 2774 - DNA, 16 bp, synthetic construct
  source 1..16: mol_type = other DNA
agtcatattgaaaatc

SEQ ID NO: 2775 - DNA, 16 bp, synthetic construct
  source 1..16: mol_type = other DNA
agttagcagctaaaat

SEQ ID NO: 2776 - DNA, 16 bp, synthetic construct
  source 1..16: mol_type = other DNA
caacgcaacagtttag

SEQ ID NO: 2777 - DNA, 16 bp, synthetic construct
  source 1..16: mol_type = other DNA
agcattccatgattaa

SEQ ID NO: 2778 - DNA, 16 bp, synthetic construct
  source 1..16: mol_type = other DNA
ccaaggcttatgaagt

SEQ ID NO: 2779 - DNA, 16 bp, synthetic construct
  source 1..16: mol_type = other DNA
tctaaagtgctggttg

SEQ ID NO: 2780 - DNA, 16 bp, synthetic construct
  source 1..16: mol_type = other DNA
gcaccaactatgtaat

SEQ ID NO: 2781 - DNA, 16 bp, synthetic construct
  source 1..16: mol_type = other DNA
tcagatcccgttcttg

SEQ ID NO: 2782 - DNA, 16 bp, synthetic construct
  source 1..16: mol_type = other DNA
ctcctgagtctttcta

SEQ ID NO: 2783 - DNA, 16 bp, synthetic construct
  source 1..16: mol_type = other DNA
tgctttagcttaaact

SEQ ID NO: 2784 - DNA, 16 bp, synthetic construct
  source 1..16: mol_type = other DNA
gctaaaatggtcatct

SEQ ID NO: 2785 - DNA, 16 bp, synthetic construct
  source 1..16: mol_type = other DNA
tttataactacaagag

SEQ ID NO: 2786 - DNA, 16 bp, synthetic construct
  source 1..16: mol_type = other DNA
acagactgttgagctc

SEQ ID NO: 2787 - DNA, 16 bp, synthetic construct
  source 1..16: mol_type = other DNA
ttttgtccacctttaa

SEQ ID NO: 2788 - DNA, 16 bp, synthetic construct
  source 1..16: mol_type = other DNA
cgatcctatatacatc

SEQ ID NO: 2789 - DNA, 16 bp, synthetic construct
  source 1..16: mol_type = other DNA
tcccaacccaagctac

SEQ ID NO: 2790 - DNA, 16 bp, synthetic construct
  source 1..16: mol_type = other DNA
taagatacccaggttg

SEQ ID NO: 2791 - DNA, 16 bp, synthetic construct
  source 1..16: mol_type = other DNA
gaccagggaatttatc

SEQ ID NO: 2792 - DNA, 16 bp, synthetic construct
  source 1..16: mol_type = other DNA
tgaatcatgattgaat

SEQ ID NO: 2793 - DNA, 16 bp, synthetic construct
  source 1..16: mol_type = other DNA
gcattcatcagatgtt

SEQ ID NO: 2794 - DNA, 16 bp, synthetic construct
  source 1..16: mol_type = other DNA
ctgccagggaatgctc

SEQ ID NO: 2795 - DNA, 16 bp, synthetic construct
  source 1..16: mol_type = other DNA
acttttccgtctcaca

SEQ ID NO: 2796 - DNA, 16 bp, synthetic construct
  source 1..16: mol_type = other DNA
tcagtagagagcataa

SEQ ID NO: 2797 - DNA, 16 bp, synthetic construct
  source 1..16: mol_type = other DNA
tgagataaagctgcct

SEQ ID NO: 2798 - DNA, 16 bp, synthetic construct
  source 1..16: mol_type = other DNA
tggtagcttgctcact

SEQ ID NO: 2799 - DNA, 16 bp, synthetic construct
  source 1..16: mol_type = other DNA
gccactggatggattt

SEQ ID NO: 2800 - DNA, 16 bp, synthetic construct
  source 1..16: mol_type = other DNA
ctgcaacttttagtca

SEQ ID NO: 2801 - DNA, 16 bp, synthetic construct
  source 1..16: mol_type = other DNA
ctgccctagattctac

SEQ ID NO: 2802 - DNA, 16 bp, synthetic construct
  source 1..16: mol_type = other DNA
gagttagggagccagc

SEQ ID NO: 2803 - DNA, 16 bp, synthetic construct
  source 1..16: mol_type = other DNA
ttcaactaaacatgac

SEQ ID NO: 2804 - DNA, 16 bp, synthetic construct
  source 1..16: mol_type = other DNA
agactttgagactctt

SEQ ID NO: 2805 - DNA, 16 bp, synthetic construct
  source 1..16: mol_type = other DNA
gtttacaagtaagaac

SEQ ID NO: 2806 - DNA, 16 bp, synthetic construct
  source 1..16: mol_type = other DNA
gtgcatcttaagatac

SEQ ID NO: 2807 - DNA, 16 bp, synthetic construct
  source 1..16: mol_type = other DNA
ttaaaccttccctgtg

SEQ ID NO: 2808 - DNA, 16 bp, synthetic construct
  source 1..16: mol_type = other DNA
tatagactgggtagga

SEQ ID NO: 2809 - DNA, 16 bp, synthetic construct
  source 1..16: mol_type = other DNA
aggctgtaagagtcag

SEQ ID NO: 2810 - DNA, 16 bp, synthetic construct
  source 1..16: mol_type = other DNA
ggagtgcatcttaaga

SEQ ID NO: 2811 - DNA, 16 bp, synthetic construct
  source 1..16: mol_type = other DNA
aagttagcccccagga

SEQ ID NO: 2812 - DNA, 16 bp, synthetic construct
  source 1..16: mol_type = other DNA
cctcgatcctatatac

SEQ ID NO: 2813 - DNA, 16 bp, synthetic construct
  source 1..16: mol_type = other DNA
  modified_base 5: mod_base = OTHER; note = uracil
agtcttaaaccttccc

SEQ ID NO: 2814 - DNA, 16 bp, synthetic construct
  source 1..16: mol_type = other DNA
  modified_base 5: mod_base = OTHER; note = uracil
cagattggaatgctac

SEQ ID NO: 2815 - DNA, 16 bp, synthetic construct
  source 1..16: mol_type = other DNA
  modified_base 5: mod_base = OTHER; note = uracil
ggaatgctacttgaac

SEQ ID NO: 2816 - DNA, 16 bp, synthetic construct
  source 1..16: mol_type = other DNA
  modified_base 5: mod_base = OTHER; note = uracil
ttgatattctgtggca

SEQ ID NO: 2817 - DNA, 16 bp, synthetic construct
  source 1..16: mol_type = other DNA
  modified_base 5: mod_base = OTHER; note = uracil
gtgttcttgttgatat

SEQ ID NO: 2818 - DNA, 16 bp, synthetic construct
  source 1..16: mol_type = other DNA
  modified_base 5: mod_base = OTHER; note = uracil
ctcttagctgtgcact

SEQ ID NO: 2819 - DNA, 16 bp, synthetic construct
  source 1..16: mol_type = other DNA
  modified_base 5: mod_base = OTHER; note = uracil
aggttgagataaagct

SEQ ID NO: 2820 - DNA, 16 bp, synthetic construct
  source 1..16: mol_type = other DNA
  modified_base 5: mod_base = OTHER; note = uracil
gacatgaggttttgat

SEQ ID NO: 2821 - DNA, 16 bp, synthetic construct
  source 1..16: mol_type = other DNA
  modified_base 5: mod_base = OTHER; note = uracil
gagataaagctgcctg

SEQ ID NO: 2822 - DNA, 16 bp, synthetic construct
  source 1..16: mol_type = other DNA
  modified_base 5: mod_base = OTHER; note = uracil
aggctagggaaatctt

SEQ ID NO: 2823 - DNA, 16 bp, synthetic construct
  source 1..16: mol_type = other DNA
  modified_base 5: mod_base = OTHER; note = uracil
ccgttttgggctaatg

SEQ ID NO: 2824 - DNA, 16 bp, synthetic construct
  source 1..16: mol_type = other DNA
  modified_base 5: mod_base = OTHER; note = uracil
atcttataagactata

SEQ ID NO: 2825 - DNA, 16 bp, synthetic construct
  source 1..16: mol_type = other DNA
  modified_base 5: mod_base = OTHER; note = uracil
gagttgcaccgttttg

SEQ ID NO: 2826 - DNA, 16 bp, synthetic construct
  source 1..16: mol_type = other DNA
  modified_base 5: mod_base = OTHER; note = uracil
aaaatagagtcggtca

SEQ ID NO: 2827 - DNA, 16 bp, synthetic construct
  source 1..16: mol_type = other DNA
  modified_base 5: mod_base = OTHER; note = uracil
catctctgggaccaag

SEQ ID NO: 2828 - DNA, 16 bp, synthetic construct
  source 1..16: mol_type = other DNA
  modified_base 5: mod_base = OTHER; note = uracil
cctgtgttagctttaa

SEQ ID NO: 2829 - DNA, 16 bp, synthetic construct
  source 1..16: mol_type = other DNA
  modified_base 5: mod_base = OTHER; note = uracil
tgtctaaacatctctg

SEQ ID NO: 2830 - DNA, 16 bp, synthetic construct
  source 1..16: mol_type = other DNA
  modified_base 5: mod_base = OTHER; note = uracil
tttcttatgtaatagc

SEQ ID NO: 2831 - DNA, 16 bp, synthetic construct
  source 1..16: mol_type = other DNA
  modified_base 5: mod_base = OTHER; note = uracil
gtaatagccagtacag

SEQ ID NO: 2832 - DNA, 16 bp, synthetic construct
  source 1..16: mol_type = other DNA
  modified_base 5: mod_base = OTHER; note = uracil
ttagtcttgatgtagt

SEQ ID NO: 2833 - DNA, 16 bp, synthetic construct
  source 1..16: mol_type = other DNA
  modified_base 5: mod_base = OTHER; note = uracil
aggatagtccatgcaa

SEQ ID NO: 2834 - DNA, 16 bp, synthetic construct
  source 1..16: mol_type = other DNA
  modified_base 5: mod_base = OTHER; note = uracil
atcctatatacatcca

SEQ ID NO: 2835 - DNA, 16 bp, synthetic construct
  source 1..16: mol_type = other DNA
  modified_base 5: mod_base = OTHER; note = uracil
catatgtgaagagctg

SEQ ID NO: 2836 - DNA, 16 bp, synthetic construct
  source 1..16: mol_type = other DNA
  modified_base 5: mod_base = OTHER; note = uracil
gttattctcttgacaa

SEQ ID NO: 2837 - DNA, 16 bp, synthetic construct
  source 1..16: mol_type = other DNA
  modified_base 5: mod_base = OTHER; note = uracil
ttggtaagtattccat

SEQ ID NO: 2838 - DNA, 16 bp, synthetic construct
  source 1..16: mol_type = other DNA
  modified_base 5: mod_base = OTHER; note = uracil
gaagttagtatagtta

SEQ ID NO: 2839 - DNA, 16 bp, synthetic construct
  source 1..16: mol_type = other DNA
  modified_base 5: mod_base = OTHER; note = uracil
tgcatcttaagatacc

SEQ ID NO: 2840 - DNA, 16 bp, synthetic construct
  source 1..16: mol_type = other DNA
  modified_base 5: mod_base = OTHER; note = uracil
aagatacccaggttgc

SEQ ID NO: 2841 - DNA, 16 bp, synthetic construct
  source 1..16: mol_type = other DNA
  modified_base 5: mod_base = OTHER; note = uracil
acaatatgggatgagg

SEQ ID NO: 2842 - DNA, 16 bp, synthetic construct
  source 1..16: mol_type = other DNA
  modified_base 5: mod_base = OTHER; note = uracil
ggagtgcatcttaaga

SEQ ID NO: 2843 - DNA, 16 bp, synthetic construct
  source 1..16: mol_type = other DNA
  modified_base 5: mod_base = OTHER; note = uracil
acattgcagttattag

SEQ ID NO: 2844 - DNA, 16 bp, synthetic construct
  source 1..16: mol_type = other DNA
  modified_base 5: mod_base = OTHER; note = uracil
aggctgtaagagtcag

SEQ ID NO: 2845 - DNA, 16 bp, synthetic construct
  source 1..16: mol_type = other DNA
  modified_base 5: mod_base = OTHER; note = uracil
gcttttgtccaccttt

SEQ ID NO: 2846 - DNA, 16 bp, synthetic construct
  source 1..16: mol_type = other DNA
  modified_base 5: mod_base = OTHER; note = uracil
atgctacttgaacagt

SEQ ID NO: 2847 - DNA, 16 bp, synthetic construct
  source 1..16: mol_type = other DNA
  modified_base 5: mod_base = OTHER; note = uracil
tacttgaacagtctta

SEQ ID NO: 2848 - DNA, 16 bp, synthetic construct
  source 1..16: mol_type = other DNA
  modified_base 5: mod_base = OTHER; note = uracil
atattctgtggcatgg

SEQ ID NO: 2849 - DNA, 16 bp, synthetic construct
  source 1..16: mol_type = other DNA
  modified_base 5: mod_base = OTHER; note = uracil
tctcttagctgtgcac

SEQ ID NO: 2850 - DNA, 16 bp, synthetic construct
  source 1..16: mol_type = other DNA
  modified_base 5: mod_base = OTHER; note = uracil
tgtgttcttgttgata

SEQ ID NO: 2851 - DNA, 16 bp, synthetic construct
  source 1..16: mol_type = other DNA
  modified_base 5: mod_base = OTHER; note = uracil
caggttgagataaagc

SEQ ID NO: 2852 - DNA, 16 bp, synthetic construct
  source 1..16: mol_type = other DNA
  modified_base 5: mod_base = OTHER; note = uracil
accgttttgggctaat

SEQ ID NO: 2853 - DNA, 16 bp, synthetic construct
  source 1..16: mol_type = other DNA
  modified_base 5: mod_base = OTHER; note = uracil
agagttgcaccgtttt

SEQ ID NO: 2854 - DNA, 16 bp, synthetic construct
  source 1..16: mol_type = other DNA
  modified_base 5: mod_base = OTHER; note = uracil
attgtctaaacatctc

SEQ ID NO: 2855 - DNA, 16 bp, synthetic construct
  source 1..16: mol_type = other DNA
  modified_base 5: mod_base = OTHER; note = uracil
cttatgtaatagccag

SEQ ID NO: 2856 - DNA, 16 bp, synthetic construct
  source 1..16: mol_type = other DNA
  modified_base 5: mod_base = OTHER; note = uracil
acactaatattgaggc

SEQ ID NO: 2857 - DNA, 16 bp, synthetic construct
  source 1..16: mol_type = other DNA
  modified_base 5: mod_base = OTHER; note = uracil
cacatatgtgaagagc

SEQ ID NO: 2858 - DNA, 16 bp, synthetic construct
  source 1..16: mol_type = other DNA
  modified_base 5: mod_base = OTHER; note = uracil
tccataataatagctc

SEQ ID NO: 2859 - DNA, 16 bp, synthetic construct
  source 1..16: mol_type = other DNA
  modified_base 5: mod_base = OTHER; note = uracil
ttagttagaatagtct

SEQ ID NO: 2860 - DNA, 16 bp, synthetic construct
  source 1..16: mol_type = other DNA
  modified_base 5: mod_base = OTHER; note = uracil
ctttttatagactggg

SEQ ID NO: 2861 - DNA, 16 bp, synthetic construct
  source 1..16: mol_type = other DNA
  modified_base 5: mod_base = OTHER; note = uracil
ttagtatagttatctt

SEQ ID NO: 2862 - DNA, 16 bp, synthetic construct
  source 1..16: mol_type = other DNA
  modified_base 5: mod_base = OTHER; note = uracil
ctgctgctagtgccaa

SEQ ID NO: 2863 - DNA, 16 bp, synthetic construct
  source 1..16: mol_type = other DNA
  modified_base 5: mod_base = OTHER; note = uracil
agactttgagactctt

SEQ ID NO: 2864 - DNA, 16 bp, synthetic construct
  source 1..16: mol_type = other DNA
  modified_base 5: mod_base = OTHER; note = uracil
atcttaagatacccag

SEQ ID NO: 2865 - DNA, 16 bp, synthetic construct
  source 1..16: mol_type = other DNA
  modified_base 5: mod_base = OTHER; note = uracil
cagttttcctcatgat

SEQ ID NO: 2866 - DNA, 16 bp, synthetic construct
  source 1..16: mol_type = other DNA
  modified_base 5: mod_base = OTHER; note = uracil
acagtcttaaaccttc

SEQ ID NO: 2867 - DNA, 16 bp, synthetic construct
  source 1..16: mol_type = other DNA
  modified_base 5: mod_base = OTHER; note = uracil
agcttttgtccacctt

SEQ ID NO: 2868 - DNA, 16 bp, synthetic construct
  source 1..16: mol_type = other DNA
  modified_base 5: mod_base = OTHER; note = uracil
ctacttgaacagtctt

SEQ ID NO: 2869 - DNA, 16 bp, synthetic construct
  source 1..16: mol_type = other DNA
  modified_base 5: mod_base = OTHER; note = uracil
gatattctgtggcatg

SEQ ID NO: 2870 - DNA, 16 bp, synthetic construct
  source 1..16: mol_type = other DNA
  modified_base 5: mod_base = OTHER; note = uracil
tagctgtgcactcatt

SEQ ID NO: 2871 - DNA, 16 bp, synthetic construct
  source 1..16: mol_type = other DNA
  modified_base 5: mod_base = OTHER; note = uracil
gatctcttagctgtgc

SEQ ID NO: 2872 - DNA, 16 bp, synthetic construct
  source 1..16: mol_type = other DNA
  modified_base 5: mod_base = OTHER; note = uracil
gttttgggctaatgaa

SEQ ID NO: 2873 - DNA, 16 bp, synthetic construct
  source 1..16: mol_type = other DNA
  modified_base 5: mod_base = OTHER; note = uracil
gtattccatctatcag

SEQ ID NO: 2874 - DNA, 16 bp, synthetic construct
  source 1..16: mol_type = other DNA
  modified_base 5: mod_base = OTHER; note = uracil
aacatctctgggacca

SEQ ID NO: 2875 - DNA, 16 bp, synthetic construct
  source 1..16: mol_type = other DNA
  modified_base 5: mod_base = OTHER; note = uracil
gtcttgatgtagtggg

SEQ ID NO: 2876 - DNA, 16 bp, synthetic construct
  source 1..16: mol_type = other DNA
  modified_base 5: mod_base = OTHER; note = uracil
cttattggtaagtatt

SEQ ID NO: 2877 - DNA, 16 bp, synthetic construct
  source 1..16: mol_type = other DNA
  modified_base 5: mod_base = OTHER; note = uracil
cagattattatgtgat

SEQ ID NO: 2878 - DNA, 16 bp, synthetic construct
  source 1..16: mol_type = other DNA
  modified_base 5: mod_base = OTHER; note = uracil
ttaatgccaccctacc

SEQ ID NO: 2879 - DNA, 16 bp, synthetic construct
  source 1..16: mol_type = other DNA
  modified_base 5: mod_base = OTHER; note = uracil
gaaattgatacaccaa

SEQ ID NO: 2880 - DNA, 16 bp, synthetic construct
  source 1..16: mol_type = other DNA
  modified_base 5: mod_base = OTHER; note = uracil
ctgctagtgccaaacc

SEQ ID NO: 2881 - DNA, 16 bp, synthetic construct
  source 1..16: mol_type = other DNA
  modified_base 5: mod_base = OTHER; note = uracil
catcttaagataccca

SEQ ID NO: 2882 - DNA, 16 bp, synthetic construct
  source 1..16: mol_type = other DNA
  modified_base 5: mod_base = OTHER; note = uracil
gcagttattagaagtc

SEQ ID NO: 2883 - DNA, 16 bp, synthetic construct
  source 1..16: mol_type = other DNA
  modified_base 5: mod_base = OTHER; note = uracil
aacttcatagtggact

SEQ ID NO: 2884 - DNA, 16 bp, synthetic construct
  source 1..16: mol_type = other DNA
  modified_base 5: mod_base = OTHER; note = uracil
acagtaaaattatgcc

SEQ ID NO: 2885 - DNA, 16 bp, synthetic construct
  source 1..16: mol_type = other DNA
ttgagttctccactgc

SEQ ID NO: 2886 - DNA, 16 bp, synthetic construct
  source 1..16: mol_type = other DNA
  modified_base 5: mod_base = OTHER; note = uracil
gctgtaagagtcagta

SEQ ID NO: 2887 - DNA, 16 bp, synthetic construct
  source 1..16: mol_type = other DNA
  modified_base 5: mod_base = OTHER; note = uracil
cgtttgactgctgcta

SEQ ID NO: 2888 - DNA, 16 bp, synthetic construct
  source 1..16: mol_type = other DNA
  modified_base 5: mod_base = OTHER; note = uracil
gccttgaatagcaagc

SEQ ID NO: 2889 - DNA, 16 bp, synthetic construct
  source 1..16: mol_type = other DNA
  modified_base 5: mod_base = OTHER; note = uracil
aagttagcccccagga

SEQ ID NO: 2890 - DNA, 16 bp, synthetic construct
  source 1..16: mol_type = other DNA
  modified_base 5: mod_base = OTHER; note = uracil
tacctctaagttagcc

SEQ ID NO: 2891 - DNA, 16 bp, synthetic construct
  source 1..16: mol_type = other DNA
  modified_base 5: mod_base = OTHER; note = uracil
cctctaagttagcccc

SEQ ID NO: 2892 - DNA, 16 bp, synthetic construct
  source 1..16: mol_type = other DNA
  modified_base 5: mod_base = OTHER; note = uracil
atgtttatgtaagcac

SEQ ID NO: 2893 - DNA, 16 bp, synthetic construct
  source 1..16: mol_type = other DNA
  modified_base 5: mod_base = OTHER; note = uracil
aatatgggatgaggta

SEQ ID NO: 2894 - DNA, 16 bp, synthetic construct
  source 1..16: mol_type = other DNA
  modified_base 5: mod_base = OTHER; note = uracil
gtttttaagaggcatg

SEQ ID NO: 2895 - DNA, 16 bp, synthetic construct
  source 1..16: mol_type = other DNA
  modified_base 5: mod_base = OTHER; note = uracil
tgattgagttctccac

SEQ ID NO: 2896 - DNA, 16 bp, synthetic construct
  source 1..16: mol_type = other DNA
  modified_base 5: mod_base = OTHER; note = uracil
tagcttttgtccacct

SEQ ID NO: 2897 - DNA, 16 bp, synthetic construct
  source 1..16: mol_type = other DNA
ataagagatgagtagg

SEQ ID NO: 2898 - DNA, 16 bp, synthetic construct
  source 1..16: mol_type = other DNA
tgcgagaaatctaaga

SEQ ID NO: 2899 - DNA, 16 bp, synthetic construct
  source 1..16: mol_type = other DNA
tataacatggctggca

SEQ ID NO: 2900 - DNA, 16 bp, synthetic construct
  source 1..16: mol_type = other DNA
aaaatatgtccaggtt

SEQ ID NO: 2901 - DNA, 16 bp, synthetic construct
  source 1..16: mol_type = other DNA
gtagtgtaagctgaga

SEQ ID NO: 2902 - DNA, 16 bp, synthetic construct
  source 1..16: mol_type = other DNA
atgttatctcaagtca

SEQ ID NO: 2903 - DNA, 16 bp, synthetic construct
  source 1..16: mol_type = other DNA
gatttaaaatagagtc

SEQ ID NO: 2904 - DNA, 16 bp, synthetic construct
  source 1..16: mol_type = other DNA
ctcccacaaaactaac

SEQ ID NO: 2905 - DNA, 16 bp, synthetic construct
  source 1..16: mol_type = other DNA
ttctgtaggactctgc

SEQ ID NO: 2906 - DNA, 16 bp, synthetic construct
  source 1..16: mol_type = other DNA
aaaattatgccttgtg

SEQ ID NO: 2907 - DNA, 16 bp, synthetic construct
  source 1..16: mol_type = other DNA
tacattagcaagctaa

SEQ ID NO: 2908 - DNA, 16 bp, synthetic construct
  source 1..16: mol_type = other DNA
gctgagagttatctgg

SEQ ID NO: 2909 - DNA, 16 bp, synthetic construct
  source 1..16: mol_type = other DNA
tcatagtttatatgga

SEQ ID NO: 2910 - DNA, 16 bp, synthetic construct
  source 1..16: mol_type = other DNA
ttgaagacaatacagg

SEQ ID NO: 2911 - DNA, 16 bp, synthetic construct
  source 1..16: mol_type = other DNA
ataggctaaaatggtc

SEQ ID NO: 2912 - DNA, 16 bp, synthetic construct
  source 1..16: mol_type = other DNA
aaaagactttgagact

SEQ ID NO: 2913 - DNA, 16 bp, synthetic construct
  source 1..16: mol_type = other DNA
acagaggagtttgcag

SEQ ID NO: 2914 - DNA, 16 bp, synthetic construct
  source 1..16: mol_type = other DNA
ttttaagaggcatgaa

SEQ ID NO: 2915 - DNA, 16 bp, synthetic construct
  source 1..16: mol_type = other DNA
catcaagacattctag

SEQ ID NO: 2916 - DNA, 16 bp, synthetic construct
  source 1..16: mol_type = other DNA
aactgaaggtctgagc

SEQ ID NO: 2917 - DNA, 16 bp, synthetic construct
  source 1..16: mol_type = other DNA
tgaatgtaaaggctgg

SEQ ID NO: 2918 - DNA, 16 bp, synthetic construct
  source 1..16: mol_type = other DNA
tacagttccttttcct

SEQ ID NO: 2919 - DNA, 16 bp, synthetic construct
  source 1..16: mol_type = other DNA
tcgggaagtttagaca

SEQ ID NO: 2920 - DNA, 16 bp, synthetic construct
  source 1..16: mol_type = other DNA
gactttcatagggaga

SEQ ID NO: 2921 - DNA, 16 bp, synthetic construct
  source 1..16: mol_type = other DNA
attatgaggatctgga

SEQ ID NO: 2922 - DNA, 16 bp, synthetic construct
  source 1..16: mol_type = other DNA
gattacccctggcttt

SEQ ID NO: 2923 - DNA, 16 bp, synthetic construct
  source 1..16: mol_type = other DNA
tatcataccacatacc

SEQ ID NO: 2924 - DNA, 16 bp, synthetic construct
  source 1..16: mol_type = other DNA
cactgatttagttggt

SEQ ID NO: 2925 - DNA, 16 bp, synthetic construct
  source 1..16: mol_type = other DNA
ccagtaggtgtgtttc

SEQ ID NO: 2926 - DNA, 16 bp, synthetic construct
  source 1..16: mol_type = other DNA
ggtcagtagagagcat

SEQ ID NO: 2927 - DNA, 16 bp, synthetic construct
  source 1..16: mol_type = other DNA
gataccagtttttccc

SEQ ID NO: 2928 - DNA, 16 bp, synthetic construct
  source 1..16: mol_type = other DNA
agatgtacactgacaa

SEQ ID NO: 2929 - DNA, 16 bp, synthetic construct
  source 1..16: mol_type = other DNA
tgcagttattagaagt

SEQ ID NO: 2930 - DNA, 16 bp, synthetic construct
  source 1..16: mol_type = other DNA
ctccgttataagtttc

SEQ ID NO: 2931 - DNA, 16 bp, synthetic construct
  source 1..16: mol_type = other DNA
actagaactcccaacc

SEQ ID NO: 2932 - DNA, 16 bp, synthetic construct
  source 1..16: mol_type = other DNA
ttagagtgcttagttc

SEQ ID NO: 2933 - DNA, 16 bp, synthetic construct
  source 1..16: mol_type = other DNA
tttagcagcttggaag

SEQ ID NO: 2934 - DNA, 16 bp, synthetic construct
  source 1..16: mol_type = other DNA
tgatatgtcaatactc

SEQ ID NO: 2935 - DNA, 16 bp, synthetic construct
  source 1..16: mol_type = other DNA
ggatatgtcatctaaa

SEQ ID NO: 2936 - DNA, 16 bp, synthetic construct
  source 1..16: mol_type = other DNA
gtcctttgtatttcgc

SEQ ID NO: 2937 - DNA, 16 bp, synthetic construct
  source 1..16: mol_type = other DNA
attttcagatcccgtt

SEQ ID NO: 2938 - DNA, 16 bp, synthetic construct
  source 1..16: mol_type = other DNA
tacagactaagggacc

SEQ ID NO: 2939 - DNA, 16 bp, synthetic construct
  source 1..16: mol_type = other DNA
ccccaaacatggatgt

SEQ ID NO: 2940 - DNA, 16 bp, synthetic construct
  source 1..16: mol_type = other DNA
ttattggtaagtattc

SEQ ID NO: 2941 - DNA, 16 bp, synthetic construct
  source 1..16: mol_type = other DNA
ggctactttcaaacct

SEQ ID NO: 2942 - DNA, 16 bp, synthetic construct
  source 1..16: mol_type = other DNA
gttttgcaagtttatc

SEQ ID NO: 2943 - DNA, 16 bp, synthetic construct
  source 1..16: mol_type = other DNA
agtagtaattctaaac

SEQ ID NO: 2944 - DNA, 16 bp, synthetic construct
  source 1..16: mol_type = other DNA
tccgaaaaaagtggag

SEQ ID NO: 2945 - DNA, 16 bp, synthetic construct
  source 1..16: mol_type = other DNA
gagagaacttatacaa

SEQ ID NO: 2946 - DNA, 16 bp, synthetic construct
  source 1..16: mol_type = other DNA
cagaaggatttctagg

SEQ ID NO: 2947 - DNA, 16 bp, synthetic construct
  source 1..16: mol_type = other DNA
cccgcccttaagtcat

SEQ ID NO: 2948 - DNA, 16 bp, synthetic construct
  source 1..16: mol_type = other DNA
gctagacaattgcaaa

SEQ ID NO: 2949 - DNA, 16 bp, synthetic construct
  source 1..16: mol_type = other DNA
ttcccaacgcaacagt

SEQ ID NO: 2950 - DNA, 16 bp, synthetic construct
  source 1..16: mol_type = other DNA
gagcattcatcagatg

SEQ ID NO: 2951 - DNA, 16 bp, synthetic construct
  source 1..16: mol_type = other DNA
agttttcacctcaggt

SEQ ID NO: 2952 - DNA, 16 bp, synthetic construct
  source 1..16: mol_type = other DNA
agacagaccaagtagc

SEQ ID NO: 2953 - DNA, 16 bp, synthetic construct
  source 1..16: mol_type = other DNA
accacactaatgaatc

SEQ ID NO: 2954 - DNA, 16 bp, synthetic construct
  source 1..16: mol_type = other DNA
tgagatgggcaaggcc

SEQ ID NO: 2955 - DNA, 16 bp, synthetic construct
  source 1..16: mol_type = other DNA
ggcaagacagactgtt

SEQ ID NO: 2956 - DNA, 16 bp, synthetic construct
  source 1..16: mol_type = other DNA
gattgagttctccact

SEQ ID NO: 2957 - DNA, 16 bp, synthetic construct
  source 1..16: mol_type = other DNA
ttagaatagtcttcag

SEQ ID NO: 2958 - DNA, 16 bp, synthetic construct
  source 1..16: mol_type = other DNA
agctggtaaaggtaag

SEQ ID NO: 2959 - DNA, 16 bp, synthetic construct
  source 1..16: mol_type = other DNA
atgtagtgtttacaag

SEQ ID NO: 2960 - DNA, 16 bp, synthetic construct
  source 1..16: mol_type = other DNA
gttaacctgcagcaga

SEQ ID NO: 2961 - DNA, 16 bp, synthetic construct
  source 1..16: mol_type = other DNA
tagaaactgctcctca

SEQ ID NO: 2962 - DNA, 16 bp, synthetic construct
  source 1..16: mol_type = other DNA
gtgacataactacttc

SEQ ID NO: 2963 - DNA, 16 bp, synthetic construct
  source 1..16: mol_type = other DNA
taagtgtaagagacat

SEQ ID NO: 2964 - DNA, 16 bp, synthetic construct
  source 1..16: mol_type = other DNA
ggagctagatactcaa

SEQ ID NO: 2965 - DNA, 16 bp, synthetic construct
  source 1..16: mol_type = other DNA
tcctacagtgcttagt

SEQ ID NO: 2966 - DNA, 16 bp, synthetic construct
  source 1..16: mol_type = other DNA
aaggagccagttatga

SEQ ID NO: 2967 - DNA, 16 bp, synthetic construct
  source 1..16: mol_type = other DNA
atgcagctataggtag

SEQ ID NO: 2968 - DNA, 16 bp, synthetic construct
  source 1..16: mol_type = other DNA
  modified_base 5: mod_base = OTHER; note = uracil
gtcttaaaccttccct

SEQ ID NO: 2969 - DNA, 16 bp, synthetic construct
  source 1..16: mol_type = other DNA
  modified_base 5: mod_base = OTHER; note = uracil
gttcttgttgatattc

SEQ ID NO: 2970 - DNA, 16 bp, synthetic construct
  source 1..16: mol_type = other DNA
  modified_base 5: mod_base = OTHER; note = uracil
attctgtggcatggct

SEQ ID NO: 2971 - DNA, 16 bp, synthetic construct
  source 1..16: mol_type = other DNA
  modified_base 5: mod_base = OTHER; note = uracil
ttgatctcttagctgt

SEQ ID NO: 2972 - DNA, 16 bp, synthetic construct
  source 1..16: mol_type = other DNA
  modified_base 5: mod_base = OTHER; note = uracil
cgttttgggctaatga

SEQ ID NO: 2973 - DNA, 16 bp, synthetic construct
  source 1..16: mol_type = other DNA
  modified_base 5: mod_base = OTHER; note = uracil
agagtcggtcaccttt

SEQ ID NO: 2974 - DNA, 16 bp, synthetic construct
  source 1..16: mol_type = other DNA
  modified_base 5: mod_base = OTHER; note = uracil
agaatagagttgcacc

SEQ ID NO: 2975 - DNA, 16 bp, synthetic construct
  source 1..16: mol_type = other DNA
  modified_base 5: mod_base = OTHER; note = uracil
tcggtcacctttcata

SEQ ID NO: 2976 - DNA, 16 bp, synthetic construct
  source 1..16: mol_type = other DNA
  modified_base 5: mod_base = OTHER; note = uracil
ccagtacagttccttt

SEQ ID NO: 2977 - DNA, 16 bp, synthetic construct
  source 1..16: mol_type = other DNA
  modified_base 5: mod_base = OTHER; note = uracil
tatgtaatagccagta

SEQ ID NO: 2978 - DNA, 16 bp, synthetic construct
  source 1..16: mol_type = other DNA
  modified_base 5: mod_base = OTHER; note = uracil
gatgtagtgggagtcg

SEQ ID NO: 2979 - DNA, 16 bp, synthetic construct
  source 1..16: mol_type = other DNA
  modified_base 5: mod_base = OTHER; note = uracil
ttcttatgtaatagcc

SEQ ID NO: 2980 - DNA, 16 bp, synthetic construct
  source 1..16: mol_type = other DNA
  modified_base 5: mod_base = OTHER; note = uracil
atagtccatgcaaaag

SEQ ID NO: 2981 - DNA, 16 bp, synthetic construct
  source 1..16: mol_type = other DNA
  modified_base 5: mod_base = OTHER; note = uracil
aatattgaggcactgg

SEQ ID NO: 2982 - DNA, 16 bp, synthetic construct
  source 1..16: mol_type = other DNA
  modified_base 5: mod_base = OTHER; note = uracil
cctatatacatccaag

SEQ ID NO: 2983 - DNA, 16 bp, synthetic construct
  source 1..16: mol_type = other DNA
  modified_base 5: mod_base = OTHER; note = uracil
tctcttgacaatggtt

SEQ ID NO: 2984 - DNA, 16 bp, synthetic construct
  source 1..16: mol_type = other DNA
  modified_base 5: mod_base = OTHER; note = uracil
tatgtgattgagttct

SEQ ID NO: 2985 - DNA, 16 bp, synthetic construct
  source 1..16: mol_type = other DNA
  modified_base 5: mod_base = OTHER; note = uracil
acggtgatcaaatgta

SEQ ID NO: 2986 - DNA, 16 bp, synthetic construct
  source 1..16: mol_type = other DNA
  modified_base 5: mod_base = OTHER; note = uracil
acattagcaagctaag

SEQ ID NO: 2987 - DNA, 16 bp, synthetic construct
  source 1..16: mol_type = other DNA
  modified_base 5: mod_base = OTHER; note = uracil
gcattaatgccaccct

SEQ ID NO: 2988 - DNA, 16 bp, synthetic construct
  source 1..16: mol_type = other DNA
  modified_base 5: mod_base = OTHER; note = uracil
ctagtgccaaaccaat

SEQ ID NO: 2989 - DNA, 16 bp, synthetic construct
  source 1..16: mol_type = other DNA
  modified_base 5: mod_base = OTHER; note = uracil
gtaatcacaagtaagg

SEQ ID NO: 2990 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt 5-methylcytidine 3'-phosphorothioate
  modified_base 2..3: mod_base = OTHER; note = cEt adenosine 3'-phosphorothioate
  modified_base 4: mod_base = OTHER; note = 5-methyl-2'-deoxycytidine 3'-phosphorothioate
  modified_base 5: mod_base = OTHER; note = 2'-deoxythymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 9: mod_base = OTHER; note = 2'-deoxythymidine 3'-phosphorothioate
  modified_base 8: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = cEt guanosine 3'-phosphorothioate
  modified_base 16: mod_base = OTHER; note = cEt 5-methylcytidine
caactatgtaataggc

SEQ ID NO: 2991 - DNA, 16 bp, synthetic construct
  source 1..16: mol_type = other DNA
  modified_base <1: mod_base = OTHER; note = LICA-1 phosphodiester
  modified_base 1..3: mod_base = OTHER; note = cEt adenosine 3'-phosphorothioate
  modified_base 4: mod_base = OTHER; note = 2'-deoxyadenosine 3'-phosphorothioate
  modified_base 5: mod_base = OTHER; note = 2'-deoxythymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyguanosine 3'-phosphorothioate
  modified_base 14: mod_base = OTHER; note = cEt thymidine 3'-phosphorothioate
  modified_base 15: mod_base = OTHER; note = cEt 5-methylcytidine 3'-phosphorothioate
  modified_base 16: mod_base = OTHER; note = cEt adenosine
aaaatagagtcggtca

SEQ ID NO: 2992 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt adenosine 3'-phosphorothioate
  modified_base 2: mod_base = OTHER; note = cEt guanosine 3'-phosphorothioate
  modified_base 3: mod_base = OTHER; note = cEt 5-methylcytidine 3'-phosphorothioate
  modified_base 4: mod_base = OTHER; note = 2'-deoxyadenosine 3'-phosphorothioate
  modified_base 5: mod_base = OTHER; note = 2'-deoxythymidine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 5-methyl-2'-deoxycytidine 3'-phosphorothioate
  modified_base 14: mod_base = OTHER; note = cEt adenosine 3'-phosphorothioate
  modified_base 15: mod_base = OTHER; note = cEt guanosine 3'-phosphorothioate
  modified_base 16: mod_base = OTHER; note = cEt adenosine
agcataagttaccaga

SEQ ID NO: 2993 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt guanosine 3'-phosphorothioate
  modified_base 2..3: mod_base = OTHER; note = cEt adenosine 3'-phosphorothioate
  modified_base 4..8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11..12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = cEt thymidine 3'-phosphorothioate
  modified_base 15: mod_base = OTHER; note = cEt guanosine 3'-phosphorothioate
  modified_base 16: mod_base = OTHER; note = cEt guanosine
gaatttttgaggttgg

SEQ ID NO: 2994 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt thymidine 3'-phosphorothioate
  modified_base 2: mod_base = OTHER; note = cEt 5-methylcytidine 3'-phosphorothioate
  modified_base 3: mod_base = OTHER; note = cEt thymidine 3'-phosphorothioate
  modified_base 4: mod_base = OTHER; note = 5-methyl-2'-deoxycytidine 3'-phosphorothioate
  modified_base 5..6: mod_base = OTHER; note = 2'-deoxyadenosine 3'-phosphorothioate
  modified_base 7..8: mod_base = OTHER; note = 2'-deoxyguanosine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14..15: mod_base = OTHER; note = cEt thymidine 3'-phosphorothioate
  modified_base 16: mod_base = OTHER; note = cEt 5-methylcytidine
tctcaaggagtacttc

SEQ ID NO: 2995 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt guanosine 3'-phosphorothioate
  modified_base 2: mod_base = OTHER; note = cEt thymidine 3'-phosphorothioate
  modified_base 3: mod_base = OTHER; note = cEt 5-methylcytidine 3'-phosphorothioate
  modified_base 4: mod_base = OTHER; note = 2'-deoxyadenosine 3'-phosphorothioate
  modified_base 5: mod_base = OTHER; note = 2'-deoxythymidine 3'-phosphorothioate
  modified_base 6..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyguanosine 3'-phosphorothioate
  modified_base 14: mod_base = OTHER; note = cEt 5-methylcytidine 3'-phosphorothioate
  modified_base 15: mod_base = OTHER; note = cEt thymidine 3'-phosphorothioate
  modified_base 16: mod_base = OTHER; note = cEt guanosine
gtcataaaaatcgctg

SEQ ID NO: 2996 - DNA, 16 bp, synthetic construct
  source 1..16: mol_type = other DNA
  modified_base <1: mod_base = OTHER; note = LICA-1 phosphodiester
  modified_base 1..2: mod_base = OTHER; note = cEt adenosine 3'-phosphorothioate
  modified_base 3: mod_base = OTHER; note = cEt guanosine 3'-phosphorothioate
  modified_base 4: mod_base = OTHER; note = 2'-deoxyadenosine 3'-phosphorothioate
  modified_base 5: mod_base = OTHER; note = 2'-deoxythymidine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = cEt guanosine 3'-phosphorothioate
  modified_base 16: mod_base = OTHER; note = cEt thymidine
aagataagtagatggt

SEQ ID NO: 2997 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt guanosine 3'-phosphorothioate
  modified_base 2: mod_base = OTHER; note = cEt 5-methylcytidine 3'-phosphorothioate
  modified_base 3: mod_base = OTHER; note = cEt adenosine 3'-phosphorothioate
  modified_base 4: mod_base = OTHER; note = 5-methyl-2'-deoxycytidine 3'-phosphorothioate
  modified_base 5: mod_base = OTHER; note = 2'-deoxythymidine 3'-phosphorothioate
  modified_base 6..8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11..13: mod_base = OTHER; note = 2'-deoxythymidine 3'-phosphorothioate
  modified_base 14: mod_base = OTHER; note = cEt 5-methylcytidine 3'-phosphorothioate
  modified_base 15: mod_base = OTHER; note = cEt thymidine 3'-phosphorothioate
  modified_base 16: mod_base = OTHER; note = cEt guanosine
gcactaaaggtttctg

SEQ ID NO: 2998 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt adenosine 3'-phosphorothioate
  modified_base 3: mod_base = OTHER; note = cEt adenosine 3'-phosphorothioate
  modified_base 2: mod_base = OTHER; note = cEt thymidine 3'-phosphorothioate
  modified_base 4: mod_base = OTHER; note = 5-methyl-2'-deoxycytidine 3'-phosphorothioate
  modified_base 5: mod_base = OTHER; note = 2'-deoxythymidine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = cEt adenosine 3'-phosphorothioate
  modified_base 15: mod_base = OTHER; note = cEt guanosine 3'-phosphorothioate
  modified_base 16: mod_base = OTHER; note = cEt guanosine
atactaatgtccaagg

SEQ ID NO: 2999 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt 5-methylcytidine 3'-phosphorothioate
  modified_base 2: mod_base = OTHER; note = cEt thymidine 3'-phosphorothioate
  modified_base 3: mod_base = OTHER; note = cEt adenosine 3'-phosphorothioate
  modified_base 4: mod_base = OTHER; note = 5-methyl-2'-deoxycytidine 3'-phosphorothioate
  modified_base 5..6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = cEt 5-methylcytidine 3'-phosphorothioate
  modified_base 15: mod_base = OTHER; note = cEt thymidine 3'-phosphorothioate
  modified_base 16: mod_base = OTHER; note = cEt thymidine
ctacttgaacagtctt

SEQ ID NO: 3000 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt adenosine 3'-phosphorothioate
  modified_base 2: mod_base = OTHER; note = cEt guanosine 3'-phosphorothioate
  modified_base 3: mod_base = OTHER; note = cEt thymidine 3'-phosphorothioate
  modified_base 4: mod_base = OTHER; note = 2'-deoxythymidine 3'-phosphorothioate
  modified_base 5: mod_base = OTHER; note = 2'-deoxyadenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14: mod_base = OTHER; note = cEt adenosine 3'-phosphorothioate
  modified_base 15: mod_base = OTHER; note = cEt thymidine 3'-phosphorothioate
  modified_base 16: mod_base = OTHER; note = cEt 5-methylcytidine
agttagtatagttatc

SEQ ID NO: 3001 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt adenosine 3'-phosphorothioate
  modified_base 2: mod_base = OTHER; note = cEt 5-methylcytidine 3'-phosphorothioate
  modified_base 3: mod_base = OTHER; note = cEt adenosine 3'-phosphorothioate
  modified_base 4: mod_base = OTHER; note = 2'-deoxyadenosine 3'-phosphorothioate
  modified_base 5..9: mod_base = OTHER; note = 2'-deoxythymidine 3'-phosphorothioate
  modified_base 10..11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = cEt thymidine 3'-phosphorothioate
  modified_base 15: mod_base = OTHER; note = cEt 5-methylcytidine 3'-phosphorothioate
  modified_base 16: mod_base = OTHER; note = cEt 5-methylcytidine
acaatttttccaatcc

SEQ ID NO: 3002 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt adenosine 3'-phosphorothioate
  modified_base 2: mod_base = OTHER; note = cEt guanosine 3'-phosphorothioate
  modified_base 3: mod_base = OTHER; note = cEt thymidine 3'-phosphorothioate
  modified_base 4: mod_base = OTHER; note = 2'-deoxyguanosine 3'-phosphorothioate
  modified_base 5..6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = cEt guanosine 3'-phosphorothioate
  modified_base 15: mod_base = OTHER; note = cEt thymidine 3'-phosphorothioate
  modified_base 16: mod_base = OTHER; note = cEt adenosine
agtgaatcattcagta

SEQ ID NO: 3003 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt 5-methylcytidine 3'-phosphorothioate
  modified_base 2: mod_base = OTHER; note = cEt adenosine 3'-phosphorothioate
  modified_base 3: mod_base = OTHER; note = cEt thymidine 3'-phosphorothioate
  modified_base 4: mod_base = OTHER; note = 2'-deoxythymidine 3'-phosphorothioate
  modified_base 5: mod_base = OTHER; note = 5-methyl-2'-deoxycytidine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = cEt thymidine 3'-phosphorothioate
  modified_base 15: mod_base = OTHER; note = cEt 5-methylcytidine 3'-phosphorothioate
  modified_base 16: mod_base = OTHER; note = cEt adenosine
cattcgaatttcttca

SEQ ID NO: 3004 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt guanosine 3'-phosphorothioate
  modified_base 2: mod_base = OTHER; note = cEt thymidine 3'-phosphorothioate
  modified_base 3: mod_base = OTHER; note = cEt adenosine 3'-phosphorothioate
  modified_base 4: mod_base = OTHER; note = 2'-deoxythymidine 3'-phosphorothioate
  modified_base 5: mod_base = OTHER; note = 2'-OMe cytidine 3'-phosphorothioate
  modified_base 6..7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = cEt 5-methylcytidine 3'-phosphorothioate
  modified_base 15: mod_base = OTHER; note = cEt thymidine 3'-phosphorothioate
  modified_base 16: mod_base = OTHER; note = cEt adenosine
gtatcttataagacta

SEQ ID NO: 3005 - DNA, 16 bp, synthetic construct
  source 1..16: mol_type = other DNA
  modified_base <1: mod_base = OTHER; note = LICA-1 phosphodiester
  modified_base 1..2: mod_base = OTHER; note = cEt thymidine 3'-phosphorothioate
  modified_base 3: mod_base = OTHER; note = cEt 5-methylcytidine 3'-phosphorothioate
  modified_base 4..5: mod_base = OTHER; note = 2'-deoxythymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = cEt adenosine 3'-phosphorothioate
  modified_base 14: mod_base = OTHER; note = cEt guanosine 3'-phosphorothioate
  modified_base 15: mod_base = OTHER; note = cEt 5-methylcytidine 3'-phosphorothioate
  modified_base 16: mod_base = OTHER; note = 2'-MOE 5-methylcytidine
ttcttatgtaatagcc

SEQ ID NO: 3006 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt guanosine 3'-phosphorothioate
  modified_base 2: mod_base = OTHER; note = cEt thymidine 3'-phosphorothioate
  modified_base 3: mod_base = OTHER; note = cEt adenosine 3'-phosphorothioate
  modified_base 4: mod_base = OTHER; note = 2'-deoxythymidine 3'-phosphorothioate
  modified_base 5: mod_base = OTHER; note = 5-methyl-2'-deoxycytidine 3'-phosphorothioate
  modified_base 6..7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = cEt 5-methylcytidine 3'-phosphorothioate
  modified_base 15: mod_base = OTHER; note = cEt thymidine 3'-phosphorothioate
  modified_base 16: mod_base = OTHER; note = cEt adenosine
gtatcttataagacta

SEQ ID NO: 3007 - DNA, 16 bp, synthetic construct
  source 1..16: mol_type = other DNA
  modified_base <1: mod_base = OTHER; note = LICA-1 phosphodiester
  modified_base 1: mod_base = OTHER; note = cEt adenosine 3'-phosphorothioate
  modified_base 2: mod_base = OTHER; note = cEt 5-methylcytidine 3'-phosphorothioate
  modified_base 3: mod_base = OTHER; note = cEt thymidine 3'-phosphorothioate
  modified_base 4: mod_base = OTHER; note = 2'-deoxyadenosine 3'-phosphorothioate
  modified_base 5: mod_base = OTHER; note = 2'-deoxythymidine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = cEt 5-methylcytidine 3'-phosphorothioate
  modified_base 15: mod_base = OTHER; note = cEt adenosine 3'-phosphorothioate
  modified_base 16: mod_base = OTHER; note = cEt guanosine
actatgtaataggcag

What is claimed is:

1. An oligomeric compound, according to the following chemical structure:

(SEQ ID NO: 3003)

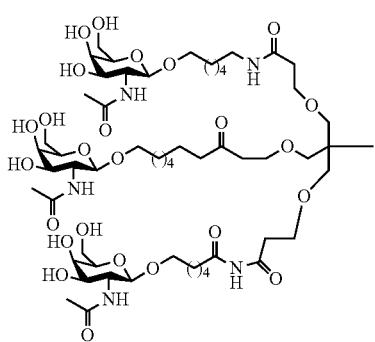
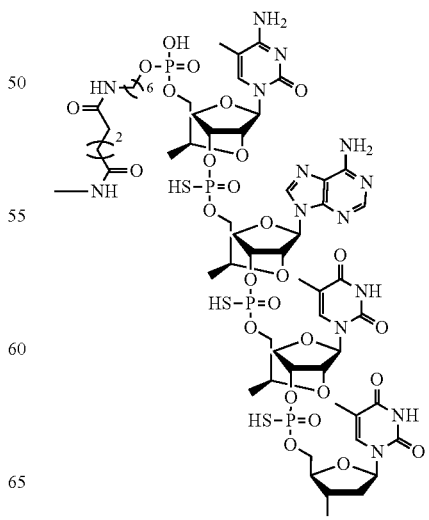

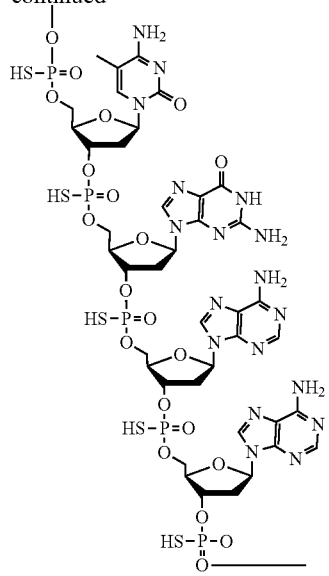
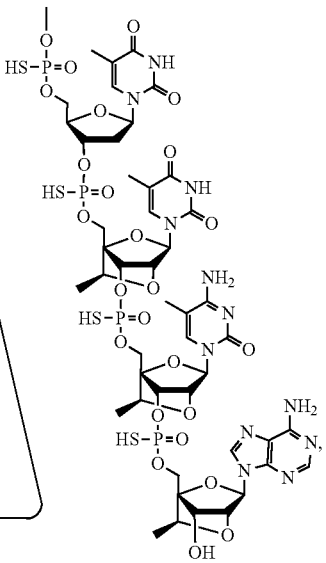
or a pharmaceutically acceptable salt thereof.
2. An oligomeric compound, according to the following chemical structure:
(SEQ ID NO. 3003)
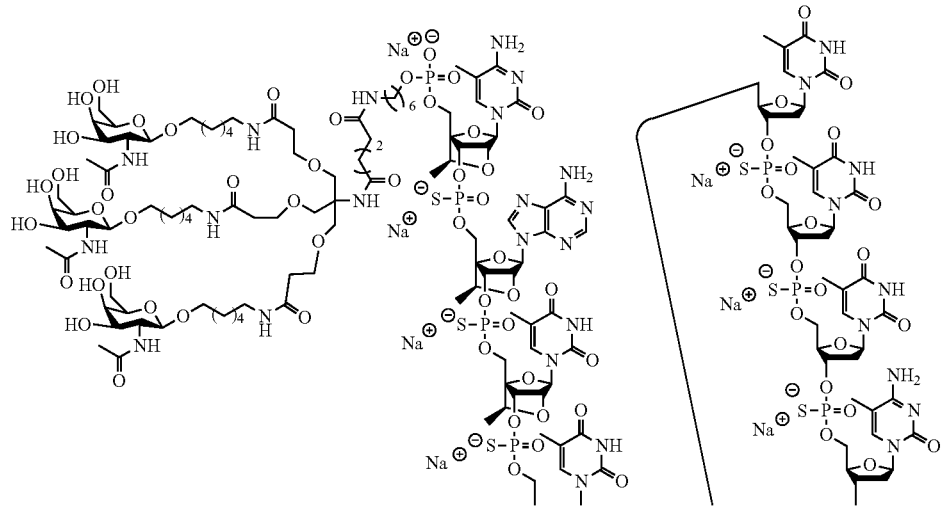

-continued

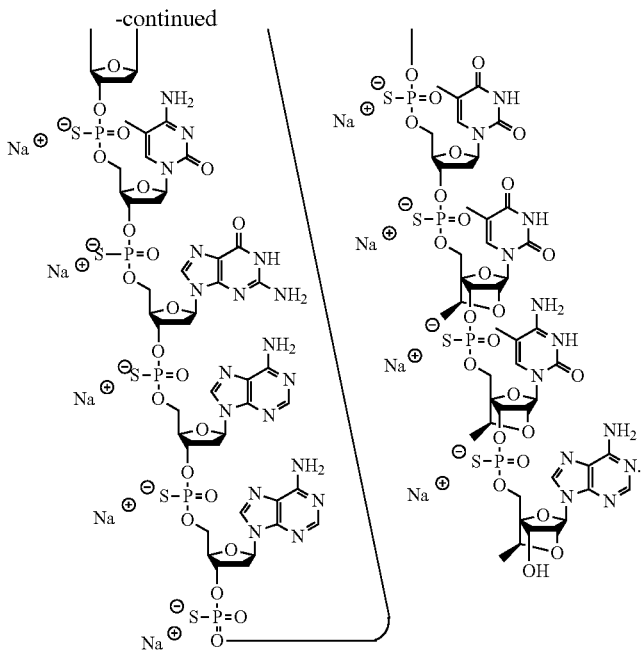

3. An oligomeric compound comprising a modified oligonucleotide consisting of 16 linked nucleosides having a nucleobase sequence SEQ ID NO: 3003, wherein the modified oligonucleotide comprises:
    a gap segment consisting of ten linked deoxynucleosides;
    a 5' wing segment consisting of three linked nucleosides; and
    a 3' wing segment consisting of three linked nucleosides;
    wherein the gap segment is positioned between the 5' wing segment and the 3' wing segment; wherein the 5' wing segment and the 3' wing segment comprise cEt sugars; wherein each internucleoside linkage is a phosphorothioate linkage; and wherein each cytosine is a 5-methylcytosine.

4. The oligomeric compound of claim 1, which is a sodium salt or a potassium salt.

5. A pharmaceutical composition comprising the oligomeric compound of claim 1 and a pharmaceutically acceptable diluent.

6. The pharmaceutical composition of claim 5, wherein the pharmaceutically acceptable diluent is water.

7. A pharmaceutical composition comprising the oligomeric compound of claim 2 and a pharmaceutically acceptable diluent.

8. The pharmaceutical composition of claim 7, wherein the pharmaceutically acceptable diluent is water.

9. A pharmaceutical composition comprising the oligomeric compound of claim 3 and a pharmaceutically acceptable diluent.

10. The pharmaceutical composition of claim 9, wherein the pharmaceutically acceptable diluent is water.

11. A method of treating a disease associated with HSD17B13 in an individual comprising administering to the individual the oligomeric compound of claim 1, thereby treating the disease.

12. The method of claim 11, wherein the individual has a liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis.

13. A method of treating a disease associated with HSD17B13 in an individual comprising administering to the individual the oligomeric compound of claim 2, thereby treating the disease.

14. The method of claim 13, wherein the individual has a liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis.

15. A method of treating a disease associated with HSD17B13 in an individual comprising administering to the individual the oligomeric compound of claim 3, thereby treating the disease.

16. The method of claim 15, wherein the individual has a liver disease, NAFLD, NASH, alcoholic steatohepatitis (ASH), alcoholic liver disease, nonalcoholic liver disease, alcoholic cirrhosis, nonalcoholic cirrhosis, steatohepatisis, hepatic steatosis, hepatocellular carcinoma, alcoholic liver disease, HCV hepatitis, chronic hepatitis, hereditary hemochromatosis, or primary sclerosing cholangitis.

* * * * *